(12) United States Patent
Henderson et al.

(10) Patent No.: US 7,425,607 B2
(45) Date of Patent: Sep. 16, 2008

(54) COMPOSITIONS COMPRISING A LUNG TUMOR ANTIGEN

(75) Inventors: Robert A Henderson, Edmonds, WA (US); Tongtong Wang, Medina, WA (US); Yoshihiro Watanabe, Mercer Island, WA (US); Michael D Kalos, Seattle, WA (US); Paul R Sleath, Seattle, WA (US); Jeffrey C Johnson, Des Moines, WA (US); Marc W Retter, Carnation, WA (US); Margarita Durham, Seattle, WA (US); Darrick Carter, Seattle, WA (US); Gary R Fanger, Mill Creek, WA (US); Thomas S Vedvick, Federal Way, WA (US); Chaitanya S Bangur, Seattle, WA (US); Andria McNabb, Renton, WA (US)

(73) Assignee: Corixa Corporation, Seattle, WA (US)

( * ) Notice: Subject to any disclaimer, the term of this patent is extended or adjusted under 35 U.S.C. 154(b) by 0 days.

(21) Appl. No.: 11/301,554

(22) Filed: Dec. 13, 2005

(65) Prior Publication Data

US 2006/0088527 A1 Apr. 27, 2006

Related U.S. Application Data

(63) Continuation of application No. 10/283,017, filed on Oct. 28, 2002, now abandoned, which is a continuation-in-part of application No. 10/113,872, filed on Mar. 28, 2002, now abandoned, which is a continuation-in-part of application No. 10/017,754, filed on Oct. 29, 2001, now Pat. No. 6,858,204, which is a continuation-in-part of application No. 09/902,941, filed on Jul. 10, 2001, now abandoned, which is a continuation-in-part of application No. 09/849,626, filed on May 3, 2001, now abandoned, which is a continuation-in-part of application No. 09/736,457, filed on Dec. 13, 2000, now Pat. No. 6,509,448, which is a continuation-in-part of application No. 09/702,705, filed on Oct. 30, 2000, now Pat. No. 6,504,010, which is a continuation-in-part of application No. 09/677,419, filed on Oct. 6, 2000, now abandoned, which is a continuation-in-part of application No. 09/671,325, filed on Sep. 26, 2000, now Pat. No. 6,667,154, which is a continuation-in-part of application No. 09/658,824, filed on Sep. 8, 2000, now Pat. No. 6,746,846, which is a continuation-in-part of application No. 09/651,563, filed on Aug. 29, 2000, now Pat. No. 6,914,132, which is a continuation-in-part of application No. 09/614,124, filed on Jul. 11, 2000, now Pat. No. 6,630,574, which is a continuation-in-part of application No. 09/589,184, filed on Jun. 5, 2000, now Pat. No. 6,686,447, which is a continuation-in-part of application No. 09/560,406, filed on Apr. 27, 2000, now abandoned, which is a continuation-in-part of application No. 09/546,259, filed on Apr. 10, 2000, now abandoned, which is a continuation-in-part of application No. 09/533,077, filed on Mar. 22, 2000, now abandoned, which is a continuation-in-part of application No. 09/519,642, filed on Mar. 6, 2000, now Pat. No. 6,933,363, which is a continuation-in-part of application No. 09/476,300, filed on Dec. 30, 1999, now abandoned, which is a continuation-in-part of application No. 09/466,867, filed on Dec. 17, 1999, now abandoned, which is a continuation-in-part of application No. 09/419,356, filed on Oct. 15, 1999, now abandoned, which is a continuation-in-part of application No. 09/346,492, filed on Jun. 30, 1999, now abandoned.

(51) Int. Cl.
*A61K 38/00* (2006.01)
*C07K 14/00* (2006.01)

(52) U.S. Cl. ...................... 530/300; 530/327
(58) Field of Classification Search .................. None
See application file for complete search history.

(56) References Cited

U.S. PATENT DOCUMENTS 5,095,093 A 3/1992 Hoffman et al. ............ 530/330

(Continued)

FOREIGN PATENT DOCUMENTS

EP 1026242 A1 8/2000

(Continued)

OTHER PUBLICATIONS

Attwood . Science 2000; 290:471-473.*

(Continued)

*Primary Examiner*—Michail A Belyavskyi
(74) *Attorney, Agent, or Firm*—Seed IP Law Group PLLC

(57) ABSTRACT

Compositions and methods for the therapy and diagnosis of cancer, particularly lung cancer, are disclosed. Illustrative compositions comprise one or more lung tumor polypeptides, immunogenic portions thereof, polynucleotides that encode such polypeptides, antigen presenting cell that expresses such polypeptides, and T cells that are specific for cells expressing such polypeptides. The disclosed compositions are useful, for example, in the diagnosis, prevention and/or treatment of diseases, particularly lung cancer.

4 Claims, No Drawings

U.S. PATENT DOCUMENTS

| | | | |
|---|---|---|---|
| 5,589,579 | A | 12/1996 | Torczynski et al. ........ 536/23.1 |
| 5,643,727 | A | 7/1997 | Reed et al. |
| 5,876,724 | A | 3/1999 | Girard et al. |
| 6,146,877 | A | 11/2000 | Fisher ..................... 435/252.3 |
| 6,177,254 | B1 | 1/2001 | Rattner et al. |
| 6,630,574 | B1 | 10/2003 | Wang et al. ................. 530/350 |
| 2002/0102604 | A1 | 8/2002 | Milne-Edwards et al. .... 435/7.1 |
| 2002/0172952 | A1 | 11/2002 | Henderson et al. ............. 435/6 |
| 2006/0088527 | A1* | 4/2006 | Henderson et al. ....... 424/133.1 |

FOREIGN PATENT DOCUMENTS

| | | |
|---|---|---|
| EP | 1033401 A2 | 9/2000 |
| EP | 1104808 A1 | 6/2001 |
| WO | WO 97/33993 | 9/1997 |
| WO | WO 97/49417 | 12/1997 |
| WO | WO 98/31799 | 7/1998 |
| WO | WO 99/01554 | 1/1999 |
| WO | WO 99/38973 | 8/1999 |
| WO | WO 99/60160 | 11/1999 |
| WO | WO 00/21990 | 4/2000 |
| WO | WO 00/22130 | 4/2000 |
| WO | WO 00/55375 | 9/2000 |
| WO | WO 01/00828 | 1/2001 |
| WO | WO 01/42451 | 6/2001 |
| WO | WO 01/51628 | 7/2001 |
| WO | WO 02/04514 | 1/2002 |

OTHER PUBLICATIONS

Skolnick et al. Trends in Biotech. 2000; 18(1):34-39.*
Whisstock et al ., Quarterly Review of Biophysics, 2003, 36, pp. 307-340.*
Miller et al, Protein Science, 1997, 6:2166-2179.*
Ngo et al, in The Protein Folding Problem and Tertiary Structure Prediction, 1994. (ed.), Birkhauser, Boston, MA, pp. 433 and 492-495.*
Sunday, Mary E., "Differential display RT-PCR for identifying novel gene expression in the lung," *Am. J. Physiol.* 269 (*Lung Cell. Mol. Physiol.* 13), pp. L273-L284, 1995.
Wang et al., "Identification of genes differentially over-expressed in lung squamous cell carcinoma using combination of cDNA substraction and microarray analysis," *Oncogene* 19, pp. 1519-1527, 2000.
Anderson, L. et al., "A comparison of selected mRNA and protein abundances in human liver," *Electrophoresis* 18: 533-537, 1997.
Brinkmann et al., "Novel Genes in the Page and Gage Family Tumor Antigens Found by Homology Walking in the dbEST Database," *Cancer Research* 59(7): 1445-1448, Apr. 1999.
Chen et al., "Isolation and characterization of a novel gene expressed in multiple cancers," *Oncogene* 12(4):741-751, Feb. 15, 1996.
GenBank Accession No. X21973, May 18, 1999.
GenBank Database, Accession No. AAG01401, Aug. 23, 2000.
GenBank Database, Accession No. AAH09538, Oct. 22, 2001.
GenBank Database, Accession No. AF251237, Aug. 23, 2000.
GenBank Database, Accession No. AJ290447, May 5, 2001.
GenBank Database, Accession No. AJ318878, Jan. 14, 2002.
GenBank Database, Accession No. AJ318879, Jan. 14, 2002.
GenBank Database, Accession No. AJ400997, May 5, 2001.
GenBank Database, Accession No. B38797, Oct. 18, 1997.
GenBank Database, Accession No. BC009538, Oct. 22, 2001.
GenBank Database, Accession No. CAB93295, Mar. 30, 2000.
GenBank Database, Accession No. CAC38107, May 5, 2001.
GenBank Database, Accession No. CAC38108, May 5, 2001.
GenBank Database, Accession No. CAC82986, Jan. 14, 2002.
GenBank Database, Accession No. CAC82987, Jan. 14, 2002.
GenBank Database, Accession No. XM_010376, Oct. 16, 2001.
GenBank Database, Accession No. XP_010376, Oct. 16, 2001.
Geneseq Database (Derwent), Accession No. AAH64751, Sep. 11, 2001.
Geneseq Database (Derwent), Accession No. AAL13774, Dec. 7, 2001.
Geneseq Database (Derwent), Accession No. AAL22641, Dec. 7, 2001.
Geneseq Database (Derwent), Accession No. AAS37109, Dec. 17, 2001.
Geneseq Database (Thomsan-Derwent), Accession No. AAA42613, Aug. 21, 2000.
Geneseq Database (Thomsan-Derwent), Accession No. AAA45936, Aug. 23, 2000.
Geneseq Database (Thomsan-Derwent), Accession No. AAAC17098, Oct. 6, 2000.
Geneseq Database (Thomsan-Derwent), Accession No. AAC10552, Oct. 6, 2000.
Geneseq Database (Thomsan-Derwent), Accession No. AAX55997, Jul. 15, 1999.
Geneseq Database (Thomson-Derwent), Accession No. AAW31603, May 11, 1998.
Güre et al., "Human lung cancer antigens recognized by autologous antibodies: definition of a novel cDNA derived from the tumor suppressor gene locus on chromosome 3p21.3," *Cancer Research* 58(1):1034-1041, Mar. 1, 1998.
Gygi, S.P. et al., "Correlation between Protein and mRNA Abundance in Yeast," *Molecular and Cellular Biology* 19(3): 1720-1730, Mar. 1999.
Hara et al., "Characterization of cell phenotype by a novel cDNA library subtraction system: expression of CD8 alpha in a mast cell-derived interleukin-4-dependant cell line," *Blood* 84(1):189-199, Jul. 1, 1994.
Hillier et al., "Generation and Analysis of 280,000 Human Expressed Sequence Tags," *Genome Research* 6:807-828, 1996.
Liu et al., "XAGE-1, a new gene that is frequently expressed in Ewing's sarcoma," *Cancer Research* 60(17):4752-4755, Sep. 1, 2000.
PIR Database, Accession No. A32645, Jun. 22, 1999.
Schena et al., "Ouantitative monitoring of gene expression patterns with a complementary DNA microarray," *Science* 270:467-470, Oct. 20, 1995.
U.S. Patent Office Examiner's Action, Tongtong Wang, U.S. Appl. No. 09/614,124, Nov. 29, 2001.
U.S. Patent Office Examiner's Final Action, Tongtong Wang, U.S. Appl. No. 09/614,124, May 1, 2002.
U.S. Patent Office Notice of Allowance, Tongtong Wang, U.S. Appl. No. 09/614,124, Nov. 12, 2002.
U.S. Patent Office Notice of Allowance, Tongtong Wang, U.S. Appl. No. 09/614,124, May 7, 2003.
Wu and Noguchi, "Activation of globin gene expression by cDNAs from induced K562 cells," *Journal of Biological Chemistry* 266(26):17566-17572, Sep. 15, 1991.
Yee, C. et al., "Isolation of Tyrosinase-Specific CD8+ and CD4+ T Cell Clones from the Peripheral Blood of Melanoma Patients Following In Vitro Stimulation with Recombinant Vaccinia Virus" *The Journal of Immunology* 157: 4079-4086, 1996.
Zangemeister-Wittke and Stahel, "Novel approaches to the treatment of small-cell lung cancer," *CMLS, Cell. Mol. Life Sci.* 55(12):1585-1598, Sep. 1999.

* cited by examiner

COMPOSITIONS COMPRISING A LUNG TUMOR ANTIGEN

CROSS-REFERENCE TO RELATED APPLICATIONS

This application is a continuation of U.S. application Ser. No. 10/283,017, filed Oct. 28, 2002 (now abandoned); which is a continuation-in-part of U.S. application Ser. No. 10/113, 872, filed Mar. 28, 2002 (now abandoned); which is a continuation-in-part of U.S. application Ser. No. 10/017,754, filed Oct. 29, 2001 (now U.S. Pat. No. 6,858,204, issued Feb. 22, 2005); which is a continuation-in-part of U.S. application Ser. No. 09/902,941, filed Jul. 10, 2001 (now abandoned); which is a continuation-in-part of U.S. application Ser. No. 09/849,626, filed May 3, 2001 (now abandoned), which is a continuation-in-part of U.S. application Ser. No. 09/736,457, filed Dec. 13, 2000 (now U.S. Pat. No. 6,509,448, issued Jan. 21, 2003); which is a continuation-in-part of U.S. application Ser. No. 09/702,705, filed Oct. 30, 2000 (now U.S. Pat. No. 6,504,010, issued Jan. 7, 2003); which is a continuation-in-part of U.S. application Ser. No. 09/677,419, filed Oct. 6, 2000 (now abandoned); which is a continuation-in-part of U.S. application Ser. No. 09/671,325, filed Sep. 26, 2000 (now U.S. Pat. No. 6,667,154, filed Dec. 23, 2003); which is a continuation-in-part of U.S. application Ser. No. 09/658, 824, filed Sep. 8, 2000 (now U.S. Pat. No. 6,746,846, issued Jun. 8, 2004); which is a continuation-in-part of U.S. application Ser. No. 09/651,563, filed Aug. 29, 2000 (now U.S. Pat. No. 6,914,132, issued Jul. 5, 2005); which is a continuation-in-part of U.S. application Ser. No. 09/614,124, filed Jul. 11, 2000 (now U.S. Pat. No. 6,630,574, issued Oct. 7, 2003); which is a continuation-in-part of U.S. application Ser. No. 09/589,184, filed Jun. 5, 2000 (now U.S. Pat. No. 6,686,447, issued Feb. 3, 2004); which is a continuation-in-part of U.S. application Ser. No. 09/560,406, filed Apr. 27, 2000 (now abandoned); which is a continuation-in-part of U.S. application Ser. No. 09/546,259, filed Apr. 10, 2000 (now abandoned); which is a continuation-in-part of U.S. application Ser. No. 09/533,077, filed Mar. 22, 2000 (now abandoned); which is a continuation-in-part of U.S. application Ser. No. 09/519,642, filed Mar. 6, 2000 (now U.S. Pat. No. 6,933,363, issued Aug. 23, 2005); which is a continuation-in-part of U.S. application Ser. No. 09/476,300, filed Dec. 30, 1999 (now abandoned); which is a continuation-in-part of U.S. application Ser. No. 09/466,867, filed Dec. 17, 1999 (now abandoned); which is a continuation-in-part of U.S. application Ser. No. 09/419,356, filed Oct. 15, 1999 (now abandoned); which is a continuation-in-part of U.S. application Ser. No. 09/346,492, filed Jun. 30, 1999 (now abandoned); all of which are hereby incorporated by reference in their entireties

STATEMENT REGARDING SEQUENCE LISTING SUBMITTED ON CD-ROM

The Sequence Listing associated with this application is provided on CD-ROM in lieu of a paper copy, and is hereby incorporated by reference into the specification. Three CD-ROMs are provided, containing identical copies of the sequence listing: CD-ROM No. 1 is labeled COPY 1, contains the file 478c21.app.txt which is 1.44 MB and created on Dec. 13, 2005; CD-ROM No. 2 is labeled COPY 2, contains the file 478c21.app.txt which is 1.44 MB and created on Dec. 13, 2005; CD-ROM No. 3 is labeled CRF (Computer Readable Form), contains the file 478c21.app.txt which is 1.44 MB and created on Dec. 13, 2005.

BACKGROUND OF THE INVENTION

1. Field of the Invention

The present invention relates generally to therapy and diagnosis of cancer, such as lung cancer. The invention is more specifically related to polypeptides, comprising at least a portion of a lung tumor protein, and to polynucleotides encoding such polypeptides. Such polypeptides and polynucleotides are useful in pharmaceutical compositions, e.g., vaccines, and other compositions for the diagnosis and treatment of lung cancer.

Cancer is a significant health problem throughout the world. Although advances have been made in detection and therapy of cancer, no vaccine or other universally successful method for prevention or treatment is currently available. Current therapies, which are generally based on a combination of chemotherapy or surgery and radiation, continue to prove inadequate in many patients.

2. Description of Related Art

Lung cancer is the primary cause of cancer death among both men and women in the U.S., with an estimated 172,000 new cases being reported in 1994. The five-year survival rate among all lung cancer patients, regardless of the stage of disease at diagnosis, is only 13%. This contrasts with a five-year survival rate of 46% among cases detected while the disease is still localized. However, only 16% of lung cancers are discovered before the disease has spread.

Early detection is difficult since clinical symptoms are often not seen until the disease has reached an advanced stage. Currently, diagnosis is aided by the use of chest x-rays, analysis of the type of cells contained in sputum and fiberoptic examination of the bronchial passages. Treatment regimens are determined by the type and stage of the cancer, and include surgery, radiation therapy and/or chemotherapy.

In spite of considerable research into therapies for this and other cancers, lung cancer remains difficult to diagnose and treat effectively. Accordingly, there is a need in the art for improved methods for detecting and treating such cancers. The present invention fulfills these needs and further provides other related advantages.

BRIEF SUMMARY OF THE INVENTION

In one aspect, the present invention provides polynucleotide compositions comprising a sequence selected from the group consisting of:

(a) sequences provided in SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, 2034-2040, 2105, 2107, 2109, 2111, 2113, 2115, and 2117;

(b) complements of the sequences provided in SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, 2034-2040, 2105, 2107, 2109, 2111, 2113, 2115, and 2117;

(c) sequences consisting of at least 20, 25, 30, 35, 40, 45, 50, 75 and 100 contiguous residues of a sequence provided in SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, 2034-2040, 2105, 2107, 2109, 2111, 2113, 2115, and 2117;

(d) sequences that hybridize to a sequence provided in SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, 2034-2040, 2105, 2107, 2109, 2111, 2113, 2115, and 2117, under moderate or highly stringent conditions;

(e) sequences having at least 75%, 80%, 85%, 90%, 95%, 96%, 97%, 98% or 99% identity to a sequence of SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, 2034-2040, 2105, 2107, 2109, 2111, 2113, 2115, and 2117;

(f) degenerate variants of a sequence provided in SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, 2034-2040, 2105, 2107, 2109, 2111, 2113, 2115, and 2117.

In one preferred embodiment, the polynucleotide compositions of the invention are expressed in at least about 20%, more preferably in at least about 30%, and most preferably in at least about 50% of lung tumors samples tested, at a level that is at least about 2-fold, preferably at least about 5-fold, and most preferably at least about 10-fold higher than that for normal tissues.

The present invention, in another aspect, provides polypeptide compositions comprising an amino acid sequence that is encoded by a polynucleotide sequence described above.

The present invention further provides polypeptide compositions comprising an amino acid sequence selected from the group consisting of sequences recited in SEQ ID NO:324-340, 783, 786, 787, 789, 791, 793, 795, 797-799, 805, 806, 809, 827, 1667, 1670-1675, 1677-1679, 1806-1822, 1825, 1830-1833, 1834-1856, 1863, 1864, 1869-1872, 1874, 1876, 1878, 1880, 1882, 1884-1890, 1901-1909, 1913, 1917, 1921, 1925-1930, 1932, 1934, 1937, 1940, 1942-1973, 2004, 2005-2011, 2012-2033, 2041-2050, 2094, 2095, 2102-2104, 2106, 2108, 2110, 2112, 2114, and 2116.

In certain preferred embodiments, the polypeptides and/or polynucleotides of the present invention are immunogenic, i.e., they are capable of eliciting an immune response, particularly a humoral and/or cellular immune response, as further described herein.

The present invention further provides fragments, variants and/or derivatives of the disclosed polypeptide and/or polynucleotide sequences, wherein the fragments, variants and/or derivatives preferably have a level of immunogenic activity of at least about 50%, preferably at least about 70% and more preferably at least about 90% of the level of immunogenic activity of a polypeptide sequence set forth in SEQ ID NO:324-340, 783, 786, 787, 789, 791, 793, 795, 797-799, 805, 806, 809, 827, 1667, 1670-1675, 1677-1679, 1806-1822, 1825, 1830-1833, 1834-1856, 1863, 1864, 1869-1872, 1874, 1876, 1878, 1880, 1882, 1884-1890, 1901-1909, 1913, 1917, 1921, 1925-1930, 1932, 1934, 1937, 1940, 1942-1973, 2004, 2005-2011, 2012-2033, 2041-2050, 2094, 2095, 2102-2104, 2106, 2108, 2110, 2112, 2114, and 2116 or a polypeptide sequence encoded by a polynucleotide sequence set forth in SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, 2041-2050, 2094, 2095, 2102-2104, 2106, 2108, 2110, 2112, 2114, and 2116.

The present invention further provides polynucleotides that encode a polypeptide described above, expression vectors comprising such polynucleotides and host cells transformed or transfected with such expression vectors.

Within other aspects, the present invention provides pharmaceutical compositions comprising a polypeptide or polynucleotide as described above and a physiologically acceptable carrier.

Within a related aspect of the present invention, the pharmaceutical compositions, e.g., vaccine compositions, are provided for prophylactic or therapeutic applications. Such compositions generally comprise an immunogenic polypeptide or polynucleotide of the invention and an immunostimulant, such as an adjuvant.

The present invention further provides pharmaceutical compositions that comprise: (a) an antibody or antigen-binding fragment thereof that specifically binds to a polypeptide of the present invention, or a fragment thereof; and (b) a physiologically acceptable carrier.

Within further aspects, the present invention provides pharmaceutical compositions comprising: (a) an antigen presenting cell that expresses a polypeptide as described above and (b) a pharmaceutically acceptable carrier or excipient. Illustrative antigen presenting cells include dendritic cells, macrophages, monocytes, fibroblasts and B cells.

Within related aspects, pharmaceutical compositions are provided that comprise: (a) an antigen presenting cell that expresses a polypeptide as described above and (b) an immunostimulant.

The present invention further provides, in other aspects, fusion proteins that comprise at least one polypeptide as described above, as well as polynucleotides encoding such fusion proteins, typically in the form of pharmaceutical compositions, e.g., vaccine compositions, comprising a physiologically acceptable carrier and/or an immunostimulant. The fusions proteins may comprise multiple immunogenic polypeptides or portions/variants thereof, as described herein, and may further comprise one or more polypeptide segments for facilitating the expression, purification and/or immunogenicity of the polypeptide(s).

Within further aspects, the present invention provides methods for stimulating an immune response in a patient, preferably a T cell response in a human patient, comprising administering a pharmaceutical composition described herein. The patient may be afflicted with lung cancer, in which case the methods provide treatment for the disease, or patient considered at risk for such a disease may be treated prophylactically.

Within further aspects, the present invention provides methods for inhibiting the development of a cancer in a patient, comprising administering to a patient a pharmaceutical composition as recited above. The patient may be afflicted with lung cancer, in which case the methods provide treatment for the disease, or patient considered at risk for such a disease may be treated prophylactically.

The present invention further provides, within other aspects, methods for removing tumor cells from a biological sample, comprising contacting a biological sample with T cells that specifically react with a polypeptide of the present invention, wherein the step of contacting is performed under conditions and for a time sufficient to permit the removal of cells expressing the protein from the sample.

Within related aspects, methods are provided for inhibiting the development of a cancer in a patient, comprising administering to a patient a biological sample treated as described above.

Methods are further provided, within other aspects, for stimulating and/or expanding T cells specific for a polypeptide of the present invention, comprising contacting T cells with one or more of: (i) a polypeptide as described above; (ii) a polynucleotide encoding such a polypeptide; and/or (iii) an antigen presenting cell that expresses such a polypeptide; under conditions and for a time sufficient to permit the stimulation and/or expansion of T cells. Isolated T cell populations comprising T cells prepared as described above are also provided.

Within further aspects, the present invention provides methods for inhibiting the development of a cancer in a patient, comprising administering to a patient an effective amount of a T cell population as described above.

The present invention further provides methods for inhibiting the development of a cancer in a patient, comprising the steps of: (a) incubating $CD4^+$ and/or $CD8^+$ T cells isolated from a patient with one or more of: (i) a polypeptide comprising at least an immunogenic portion of polypeptide disclosed herein; (ii) a polynucleotide encoding such a polypeptide; and (iii) an antigen-presenting cell that expressed such a polypeptide; and (b) administering to the patient an effective amount of the proliferated T cells, and thereby inhibiting the development of a cancer in the patient. Proliferated cells may, but need not, be cloned prior to administration to the patient.

Within further aspects, the present invention provides methods for determining the presence or absence of a cancer, preferably a lung cancer, in a patient comprising: (a) contacting a biological sample obtained from a patient with a binding agent that binds to a polypeptide as recited above; (b) detecting in the sample an amount of polypeptide that binds to the binding agent; and (c) comparing the amount of polypeptide with a predetermined cut-off value, and therefrom determining the presence or absence of a cancer in the patient. Within preferred embodiments, the binding agent is an antibody, more preferably a monoclonal antibody.

The present invention also provides, within other aspects, methods for monitoring the progression of a cancer in a patient. Such methods comprise the steps of: (a) contacting a biological sample obtained from a patient at a first point in time with a binding agent that binds to a polypeptide as recited above; (b) detecting in the sample an amount of polypeptide that binds to the binding agent; (c) repeating steps (a) and (b) using a biological sample obtained from the patient at a subsequent point in time; and (d) comparing the amount of polypeptide detected in step (c) with the amount detected in step (b) and therefrom monitoring the progression of the cancer in the patient.

The present invention further provides, within other aspects, methods for determining the presence or absence of a cancer in a patient, comprising the steps of: (a) contacting a biological sample obtained from a patient with an oligonucleotide that hybridizes to a polynucleotide that encodes a polypeptide of the present invention; (b) detecting in the sample a level of a polynucleotide, preferably mRNA, that hybridizes to the oligonucleotide; and (c) comparing the level of polynucleotide that hybridizes to the oligonucleotide with a predetermined cut-off value, and therefrom determining the presence or absence of a cancer in the patient. Within certain embodiments, the amount of mRNA is detected via polymerase chain reaction using, for example, at least one oligonucleotide primer that hybridizes to a polynucleotide encoding a polypeptide as recited above, or a complement of such a polynucleotide. Within other embodiments, the amount of mRNA is detected using a hybridization technique, employing an oligonucleotide probe that hybridizes to a polynucleotide that encodes a polypeptide as recited above, or a complement of such a polynucleotide.

In related aspects, methods are provided for monitoring the progression of a cancer in a patient, comprising the steps of: (a) contacting a biological sample obtained from a patient with an oligonucleotide that hybridizes to a polynucleotide that encodes a polypeptide of the present invention; (b) detecting in the sample an amount of a polynucleotide that hybridizes to the oligonucleotide; (c) repeating steps (a) and (b) using a biological sample obtained from the patient at a subsequent point in time; and (d) comparing the amount of polynucleotide detected in step (c) with the amount detected in step (b) and therefrom monitoring the progression of the cancer in the patient.

Within another aspect, the invention provides methods for determining the presence of a cancer in a patient, comprising the steps of: (a) obtaining a biological sample from the patient; (b) contacting the biological sample with a polypeptide comprising an amino acid sequence having at least 90% identity to the sequence of a polypeptide of the present invention or an immunogenic fragment thereof; (c) detecting in the sample an amount of antibody that binds to the polypeptide; and (d) comparing the amount of antibody to a predetermined cut-off value and therefrom determining the presence of a cancer in the patient. In certain embodiments, the predermined cut-off value is the amount detected in a normal control. In other embodiments, the predetermined cut-off value is 1.5 or 2 times the amount detecxted in a normal control individual or biological sample.

Within further aspects, the present invention provides antibodies, such as monoclonal antibodies, that bind to a polypeptide as described above, as well as diagnostic kits comprising such antibodies. In certain embodiments, such antibodies are coupled to one or more therapeutic agents. Diagnostic kits comprising one or more oligonucleotide probes or primers as described above are also provided.

These and other aspects of the present invention will become apparent upon reference to the following detailed description. All references disclosed herein are hereby incorporated by reference in their entirety as if each was incorporated individually.

BRIEF DESCRIPTION OF THE SEQUENCE IDENTIFIERS

SEQ ID NO:1 is the determined cDNA sequence for clone #19038, also referred to as L845P.

SEQ ID NO:2 is the determined cDNA sequence for clone #19036.

SEQ ID NO:3 is the determined cDNA sequence for clone #19034.

SEQ ID NO:4 is the determined cDNA sequence for clone #19033.

SEQ ID NO:5 is the determined cDNA sequence for clone #19032.

SEQ ID NO:6 is the determined cDNA sequence for clone #19030, also referred to as L559S.

SEQ ID NO:7 is the determined cDNA sequence for clone #19029.

SEQ ID NO:8 is the determined cDNA sequence for clone #19025.

SEQ ID NO:9 is the determined cDNA sequence for clone #19023.

SEQ ID NO:10 is the determined cDNA sequence for clone #18929.

SEQ ID NO:11 is the determined cDNA sequence for clone #19010.

SEQ ID NO:12 is the determined cDNA sequence for clone #19009.

SEQ ID NO:13 is the determined cDNA sequence for clones #19005, 19007, 19016 and 19017.

SEQ ID NO:14 is the determined cDNA sequence for clone #19004.

SEQ ID NO:15 is the determined cDNA sequence for clones #19002 and 18965.

SEQ ID NO:16 is the determined cDNA sequence for clone #18998.

SEQ ID NO:17 is the determined cDNA sequence for clone #18997.

SEQ ID NO:18 is the determined cDNA sequence for clone #18996.

SEQ ID NO:19 is the determined cDNA sequence for clone #18995.

SEQ ID NO:20 is the determined cDNA sequence for clone #18994, also known as L846P.

SEQ ID NO:21 is the determined cDNA sequence for clone #18992.

SEQ ID NO:22 is the determined cDNA sequence for clone #18991.

SEQ ID NO:23 is the determined cDNA sequence for clone #18990, also referred to as clone #20111.

SEQ ID NO:24 is the determined cDNA sequence for clone #18987.

SEQ ID NO:25 is the determined cDNA sequence for clone #18985, also referred as L839P.

SEQ ID NO:26 is the determined cDNA sequence for clone #18984, also referred to as L847P.

SEQ ID NO:27 is the determined cDNA sequence for clone #18983.

SEQ ID NO:28 is the determined cDNA sequence for clones #18976 and 18980.

SEQ ID NO:29 is the determined cDNA sequence for clone #18975.

SEQ ID NO:30 is the determined cDNA sequence for clone #18974.

SEQ ID NO:31 is the determined cDNA sequence for clone #18973.

SEQ ID NO:32 is the determined cDNA sequence for clone #18972.

SEQ ID NO:33 is the determined cDNA sequence for clone #18971, also referred to as L801P.

SEQ ID NO:34 is the determined cDNA sequence for clone #18970.

SEQ ID NO:35 is the determined cDNA sequence for clone #18966.

SEQ ID NO:36 is the determined cDNA sequence for clones #18964, 18968 and 19039.

SEQ ID NO:37 is the determined cDNA sequence for clone #18960.

SEQ ID NO:38 is the determined cDNA sequence for clone #18959.

SEQ ID NO:39 is the determined cDNA sequence for clones #18958 and 18982.

SEQ ID NO:40 is the determined cDNA sequence for clones #18956 and 19015.

SEQ ID NO:41 is the determined cDNA sequence for clone #18954, also referred to L848P.

SEQ ID NO:42 is the determined cDNA sequence for clone #18951.

SEQ ID NO:43 is the determined cDNA sequence for clone #18950.

SEQ ID NO:44 is the determined cDNA sequence for clones #18949 and 19024, also referred to as L844P.

SEQ ID NO:45 is the determined cDNA sequence for clone #18948.

SEQ ID NO:46 is the determined cDNA sequence for clone #18947, also referred to as L840P.

SEQ ID NO:47 is the determined cDNA sequence for clones #18946, 18953, 18969 and 19027.

SEQ ID NO:48 is the determined cDNA sequence for clone #18942.

SEQ ID NO:49 is the determined cDNA sequence for clone #18940, 18962, 18963, 19006, 19008, 19000, and 19031.

SEQ ID NO:50 is the determined cDNA sequence for clone #18939.

SEQ ID NO:51 is the determined cDNA sequence for clones #18938 and 18952.

SEQ ID NO:52 is the determined cDNA sequence for clone #18938.

SEQ ID NO:53 is the determined cDNA sequence for clone #18937.

SEQ ID NO:54 is the determined cDNA sequence for clones #18934, 18935, 18993 and 19022, also referred to as L548S.

SEQ ID NO:55 is the determined cDNA sequence for clone #18932.

SEQ ID NO:56 is the determined cDNA sequence for clones #18931 and 18936.

SEQ ID NO:57 is the determined cDNA sequence for clone #18930.

SEQ ID NO:58 is the determined cDNA sequence for clone #19014 (this sequence has homology to clone L773P, which is also described in co-pending U.S. application Ser. No. 09/285,479, filed Apr. 2, 1999).

SEQ ID NO:59 is the determined cDNA sequence for clone #19127.

SEQ ID NO:60 is the determined cDNA sequence for clones #19057 and 19064.

SEQ ID NO:61 is the determined cDNA sequence for clone #19122.

SEQ ID NO:62 is the determined cDNA sequence for clones #19120 and 18121.

SEQ ID NO:63 is the determined cDNA sequence for clone #19118.

SEQ ID NO:64 is the determined cDNA sequence for clone #19117.

SEQ ID NO:65 is the determined cDNA sequence for clone #19116.

SEQ ID NO:66 is the determined cDNA sequence for clone #19114.

SEQ ID NO:67 is the determined cDNA sequence for clone #19112, also known as L561S.

SEQ ID NO:68 is the determined cDNA sequence for clone #19110.

SEQ ID NO:69 is the determined cDNA sequence for clone #19107, also referred to as L552S.

SEQ ID NO:70 is the determined cDNA sequence for clone #19106, also referred to as L547S.

SEQ ID NO:71 is the determined cDNA sequence for clones #19105 and 19111.

SEQ ID NO:72 is the determined cDNA sequence for clone #19099.

SEQ ID NO:73 is the determined cDNA sequence for clones #19095, 19104 and 19125, also referred to as L549S.

SEQ ID NO:74 is the determined cDNA sequence for clone #19094.

SEQ ID NO:75 is the determined cDNA sequence for clones #19089 and 19101.

SEQ ID NO:76 is the determined cDNA sequence for clone #19088.

SEQ ID NO:77 is the determined cDNA sequence for clones #19087, 19092, 19096, 19100 and 19119.

SEQ ID NO:78 is the determined cDNA sequence for clone #19086.

SEQ ID NO:79 is the determined cDNA sequence for clone #19085, also referred to as L550S.

SEQ ID NO:80 is the determined cDNA sequence for clone #19084, also referred to as clone #19079.

SEQ ID NO:81 is the determined cDNA sequence for clone #19082.

SEQ ID NO:82 is the determined cDNA sequence for clone #19080.

SEQ ID NO:83 is the determined cDNA sequence for clone #19077.

SEQ ID NO:84 is the determined cDNA sequence for clone #19076, also referred to as L551S.

SEQ ID NO:85 is the determined cDNA sequence for clone #19074, also referred to as clone #20102.

SEQ ID NO:86 is the determined cDNA sequence for clone #19073, also referred to as L560S.

SEQ ID NO:87 is the determined cDNA sequence for clones #19072 and 19115.

SEQ ID NO:88 is the determined cDNA sequence for clone #19071.

SEQ ID NO:89 is the determined cDNA sequence for clone #19070.

SEQ ID NO:90 is the determined cDNA sequence for clone #19069.

SEQ ID NO:91 is the determined cDNA sequence for clone #19068, also referred to L563S.

SEQ ID NO:92 is the determined cDNA sequence for clone #19066.

SEQ ID NO:93 is the determined cDNA sequence for clone #19065.

SEQ ID NO:94 is the determined cDNA sequence for clone #19063.

SEQ ID NO:95 is the determined cDNA sequence for clones #19061, 19081, 19108 and 19109.

SEQ ID NO:96 is the determined cDNA sequence for clones #19060, 19067 and 19083, also referred to as L548S.

SEQ ID NO:97 is the determined cDNA sequence for clones #19059 and 19062.

SEQ ID NO:98 is the determined cDNA sequence for clone #19058.

SEQ ID NO:99 is the determined cDNA sequence for clone #19124.

SEQ ID NO:100 is the determined cDNA sequence for clone #18929.

SEQ ID NO:101 is the determined cDNA sequence for clone #18422.

SEQ ID NO:102 is the determined cDNA sequence for clone #18425.

SEQ ID NO:103 is the determined cDNA sequence for clone #18431.

SEQ ID NO:104 is the determined cDNA sequence for clone #18433.

SEQ ID NO:105 is the determined cDNA sequence for clone #18444.

SEQ ID NO:106 is the determined cDNA sequence for clone #18449.

SEQ ID NO:107 is the determined cDNA sequence for clone #18451.

SEQ ID NO:108 is the determined cDNA sequence for clone #18452.

SEQ ID NO:109 is the determined cDNA sequence for clone #18455.

SEQ ID NO:110 is the determined cDNA sequence for clone #18457.

SEQ ID NO:111 is the determined cDNA sequence for clone #18466.

SEQ ID NO:112 is the determined cDNA sequence for clone #18468.

SEQ ID NO:113 is the determined cDNA sequence for clone #18471.

SEQ ID NO:114 is the determined cDNA sequence for clone #18475.

SEQ ID NO:115 is the determined cDNA sequence for clone #18476.

SEQ ID NO:116 is the determined cDNA sequence for clone #18477.

SEQ ID NO:117 is the determined cDNA sequence for clone #20631.

SEQ ID NO:118 is the determined cDNA sequence for clone #20634.

SEQ ID NO:119 is the determined cDNA sequence for clone #20635.

SEQ ID NO:120 is the determined cDNA sequence for clone #20637.

SEQ ID NO:121 is the determined cDNA sequence for clone #20638.

SEQ ID NO:122 is the determined cDNA sequence for clone #20643.

SEQ ID NO:123 is the determined cDNA sequence for clone #20652.

SEQ ID NO:124 is the determined cDNA sequence for clone #20653.

SEQ ID NO:125 is the determined cDNA sequence for clone #20657.

SEQ ID NO:126 is the determined cDNA sequence for clone #20658.

SEQ ID NO:127 is the determined cDNA sequence for clone #20660.

SEQ ID NO:128 is the determined cDNA sequence for clone #20661.

SEQ ID NO:129 is the determined cDNA sequence for clone #20663.

SEQ ID NO:130 is the determined cDNA sequence for clone #20665.

SEQ ID NO:131 is the determined cDNA sequence for clone #20670.

SEQ ID NO:132 is the determined cDNA sequence for clone #20671.

SEQ ID NO:133 is the determined cDNA sequence for clone #20672.

SEQ ID NO:134 is the determined cDNA sequence for clone #20675.

SEQ ID NO:135 is the determined cDNA sequence for clone #20679.

SEQ ID NO:136 is the determined cDNA sequence for clone #20681.

SEQ ID NO:137 is the determined cDNA sequence for clone #20682.

SEQ ID NO:138 is the determined cDNA sequence for clone #20684.

SEQ ID NO:139 is the determined cDNA sequence for clone #20685.

SEQ ID NO:140 is the determined cDNA sequence for clone #20689.
SEQ ID NO:141 is the determined cDNA sequence for clone #20699.
SEQ ID NO:142 is the determined cDNA sequence for clone #20701.
SEQ ID NO:143 is the determined cDNA sequence for clone #20702.
SEQ ID NO:144 is the determined cDNA sequence for clone #20708.
SEQ ID NO:145 is the determined cDNA sequence for clone #20715.
SEQ ID NO:146 is the determined cDNA sequence for clone #20716.
SEQ ID NO:147 is the determined cDNA sequence for clone #20719.
SEQ ID NO:148 is the determined cDNA sequence for clone #19129.
SEQ ID NO:149 is the determined cDNA sequence for clone #19131.1.
SEQ ID NO:150 is the determined cDNA sequence for clone #19132.2.
SEQ ID NO:151 is the determined cDNA sequence for clone #19133.
SEQ ID NO:152 is the determined cDNA sequence for clone #19134.2.
SEQ ID NO:153 is the determined cDNA sequence for clone #19135.2.
SEQ ID NO:154 is the determined cDNA sequence for clone #19137.
SEQ ID NO:155 is a first determined cDNA sequence for clone #19138.1.
SEQ ID NO:156 is a second determined cDNA sequence for clone #19138.2.
SEQ ID NO:157 is the determined cDNA sequence for clone #19139.
SEQ ID NO:158 is a first determined cDNA sequence for clone #19140.1.
SEQ ID NO:159 is a second determined cDNA sequence for clone #19140.2.
SEQ ID NO:160 is the determined cDNA sequence for clone #19141.
SEQ ID NO:161 is the determined cDNA sequence for clone #19143.
SEQ ID NO:162 is the determined cDNA sequence for clone #19144.
SEQ ID NO:163 is a first determined cDNA sequence for clone #19145.1.
SEQ ID NO:164 is a second determined cDNA sequence for clone #19145.2.
SEQ ID NO:165 is the determined cDNA sequence for clone #19146.
SEQ ID NO:166 is a first determined cDNA sequence for clone #19149.1.
SEQ ID NO:167 is the determined cDNA sequence for clone #19152.
SEQ ID NO:168 is a first determined cDNA sequence for clone #19153.1.
SEQ ID NO:169 is a second determined cDNA sequence for clone #19153.2.
SEQ ID NO:170 is the determined cDNA sequence for clone #19155.
SEQ ID NO:171 is the determined cDNA sequence for clone #19157.
SEQ ID NO:172 is the determined cDNA sequence for clone #19159.
SEQ ID NO:173 is the determined cDNA sequence for clone #19160.
SEQ ID NO:174 is a first determined cDNA sequence for clone #19161.1.
SEQ ID NO:175 is a second determined cDNA sequence for clone #19161.2.
SEQ ID NO:176 is the determined cDNA sequence for clone #19162.1.
SEQ ID NO:177 is the determined cDNA sequence for clone #19166.
SEQ ID NO:178 is the determined cDNA sequence for clone #19169.
SEQ ID NO:179 is the determined cDNA sequence for clone #19171.
SEQ ID NO:180 is a first determined cDNA sequence for clone #19173.1.
SEQ ID NO:181 is a second determined cDNA sequence for clone #19173.2.
SEQ ID NO:182 is the determined cDNA sequence for clone #19174.1.
SEQ ID NO:183 is the determined cDNA sequence for clone #19175.
SEQ ID NO:184 is the determined cDNA sequence for clone #19177.
SEQ ID NO:185 is the determined cDNA sequence for clone #19178.
SEQ ID NO:186 is the determined cDNA sequence for clone #19179.1.
SEQ ID NO:187 is the determined cDNA sequence for clone #19179.2.
SEQ ID NO:188 is the determined cDNA sequence for clone #19180.
SEQ ID NO:189 is a first determined cDNA sequence for clone #19182.1.
SEQ ID NO:190 is a second determined cDNA sequence for clone #19182.2.
SEQ ID NO:191 is the determined cDNA sequence for clone #19183.1.
SEQ ID NO:192 is the determined cDNA sequence for clone #19185.1.
SEQ ID NO:193 is the determined cDNA sequence for clone #19187.
SEQ ID NO:194 is the determined cDNA sequence for clone #19188.
SEQ ID NO:195 is the determined cDNA sequence for clone #19190.
SEQ ID NO:196 is the determined cDNA sequence for clone #19191.
SEQ ID NO:197 is the determined cDNA sequence for clone #19192.
SEQ ID NO:198 is the determined cDNA sequence for clone #19193.
SEQ ID NO:199 is a first determined cDNA sequence for clone #19194.1.
SEQ ID NO:200 is a second determined cDNA sequence for clone #19194.2.
SEQ ID NO:201 is the determined cDNA sequence for clone #19197.
SEQ ID NO:202 is a first determined cDNA sequence for clone #19200.1.
SEQ ID NO:203 is a second determined cDNA sequence for clone #19200.2.
SEQ ID NO:204 is the determined cDNA sequence for clone #19202.
SEQ ID NO:205 is a first determined cDNA sequence for clone #19204.1.

SEQ ID NO:206 is a second determined cDNA sequence for clone #19204.2.
SEQ ID NO:207 is the determined cDNA sequence for clone #19205.
SEQ ID NO:208 is a first determined cDNA sequence for clone #19206.1.
SEQ ID NO:209 is a second determined cDNA sequence for clone #19206.2.
SEQ ID NO:210 is the determined cDNA sequence for clone #19207.
SEQ ID NO:211 is the determined cDNA sequence for clone #19208.
SEQ ID NO:212 is a first determined cDNA sequence for clone #19211.1.
SEQ ID NO:213 is a second determined cDNA sequence for clone #19211.2.
SEQ ID NO:214 is a first determined cDNA sequence for clone #19214.1.
SEQ ID NO:215 is a second determined cDNA sequence for clone #19214.2.
SEQ ID NO:216 is the determined cDNA sequence for clone #19215.
SEQ ID NO:217 is a first determined cDNA sequence for clone #19217.2.
SEQ ID NO:218 is a second determined cDNA sequence for clone #19217.2.
SEQ ID NO:219 is a first determined cDNA sequence for clone #19218.1.
SEQ ID NO:220 is a second determined cDNA sequence for clone #19218.2.
SEQ ID NO:221 is a first determined cDNA sequence for clone #19220.1.
SEQ ID NO:222 is a second determined cDNA sequence for clone #19220.2.
SEQ ID NO:223 is the determined cDNA sequence for clone #22015.
SEQ ID NO:224 is the determined cDNA sequence for clone #22017.
SEQ ID NO:225 is the determined cDNA sequence for clone #22019.
SEQ ID NO:226 is the determined cDNA sequence for clone #22020.
SEQ ID NO:227 is the determined cDNA sequence for clone #22023.
SEQ ID NO:228 is the determined cDNA sequence for clone #22026.
SEQ ID NO:229 is the determined cDNA sequence for clone #22027.
SEQ ID NO:230 is the determined cDNA sequence for clone #22028.
SEQ ID NO:231 is the determined cDNA sequence for clone #22032.
SEQ ID NO:232 is the determined cDNA sequence for clone #22037.
SEQ ID NO:233 is the determined cDNA sequence for clone #22045.
SEQ ID NO:234 is the determined cDNA sequence for clone #22048.
SEQ ID NO:235 is the determined cDNA sequence for clone #22050.
SEQ ID NO:236 is the determined cDNA sequence for clone #22052.
SEQ ID NO:237 is the determined cDNA sequence for clone #22053.
SEQ ID NO:238 is the determined cDNA sequence for clone #22057.
SEQ ID NO:239 is the determined cDNA sequence for clone #22066.
SEQ ID NO:240 is the determined cDNA sequence for clone #22077.
SEQ ID NO:241 is the determined cDNA sequence for clone #22085.
SEQ ID NO:242 is the determined cDNA sequence for clone #22105.
SEQ ID NO:243 is the determined cDNA sequence for clone #22108.
SEQ ID NO:244 is the determined cDNA sequence for clone #22109.
SEQ ID NO:245 is the determined cDNA sequence for clone #24842.
SEQ ID NO:246 is the determined cDNA sequence for clone #24843.
SEQ ID NO:247 is the determined cDNA sequence for clone #24845.
SEQ ID NO:248 is the determined cDNA sequence for clone #24851.
SEQ ID NO:249 is the determined cDNA sequence for clone #24852.
SEQ ID NO:250 is the determined cDNA sequence for clone #24853.
SEQ ID NO:251 is the determined cDNA sequence for clone #24854.
SEQ ID NO:252 is the determined cDNA sequence for clone #24855.
SEQ ID NO:253 is the determined cDNA sequence for clone #24860.
SEQ ID NO:254 is the determined cDNA sequence for clone #24864.
SEQ ID NO:255 is the determined cDNA sequence for clone #24866.
SEQ ID NO:256 is the determined cDNA sequence for clone #24867.
SEQ ID NO:257 is the determined cDNA sequence for clone #24868.
SEQ ID NO:258 is the determined cDNA sequence for clone #24869.
SEQ ID NO:259 is the determined cDNA sequence for clone #24870.
SEQ ID NO:260 is the determined cDNA sequence for clone #24872.
SEQ ID NO:261 is the determined cDNA sequence for clone #24873.
SEQ ID NO:262 is the determined cDNA sequence for clone #24875.
SEQ ID NO:263 is the determined cDNA sequence for clone #24882.
SEQ ID NO:264 is the determined cDNA sequence for clone #24885.
SEQ ID NO:265 is the determined cDNA sequence for clone #24886.
SEQ ID NO:266 is the determined cDNA sequence for clone #24887.
SEQ ID NO:267 is the determined cDNA sequence for clone #24888.
SEQ ID NO:268 is the determined cDNA sequence for clone #24890.
SEQ ID NO:269 is the determined cDNA sequence for clone #24896.
SEQ ID NO:270 is the determined cDNA sequence for clone #24897.
SEQ ID NO:271 is the determined cDNA sequence for clone #24899.

SEQ ID NO:272 is the determined cDNA sequence for clone #24901.
SEQ ID NO:273 is the determined cDNA sequence for clone #24902.
SEQ ID NO:274 is the determined cDNA sequence for clone #24906.
SEQ ID NO:275 is the determined cDNA sequence for clone #24912.
SEQ ID NO:276 is the determined cDNA sequence for clone #24913.
SEQ ID NO:277 is the determined cDNA sequence for clone #24920.
SEQ ID NO:278 is the determined cDNA sequence for clone #24927.
SEQ ID NO:279 is the determined cDNA sequence for clone #24930.
SEQ ID NO:280 is the determined cDNA sequence for clone #26938.
SEQ ID NO:281 is the determined cDNA sequence for clone #26939.
SEQ ID NO:282 is the determined cDNA sequence for clone #26943.
SEQ ID NO:283 is the determined cDNA sequence for clone #26948.
SEQ ID NO:284 is the determined cDNA sequence for clone #26951.
SEQ ID NO:285 is the determined cDNA sequence for clone #26955.
SEQ ID NO:286 is the determined cDNA sequence for clone #26956.
SEQ ID NO:287 is the determined cDNA sequence for clone #26959.
SEQ ID NO:288 is the determined cDNA sequence for clone #26961.
SEQ ID NO:289 is the determined cDNA sequence for clone #26962.
SEQ ID NO:290 is the determined cDNA sequence for clone #26964.
SEQ ID NO:291 is the determined cDNA sequence for clone #26966.
SEQ ID NO:292 is the determined cDNA sequence for clone #26968.
SEQ ID NO:293 is the determined cDNA sequence for clone #26972.
SEQ ID NO:294 is the determined cDNA sequence for clone #26973.
SEQ ID NO:295 is the determined cDNA sequence for clone #26974.
SEQ ID NO:296 is the determined cDNA sequence for clone #26976.
SEQ ID NO:297 is the determined cDNA sequence for clone #26977.
SEQ ID NO:298 is the determined cDNA sequence for clone #26979.
SEQ ID NO:299 is the determined cDNA sequence for clone #26980.
SEQ ID NO:300 is the determined cDNA sequence for clone #26981.
SEQ ID NO:301 is the determined cDNA sequence for clone #26984.
SEQ ID NO:302 is the determined cDNA sequence for clone #26985.
SEQ ID NO:303 is the determined cDNA sequence for clone #26986.
SEQ ID NO:304 is the determined cDNA sequence for clone #26993.
SEQ ID NO:305 is the determined cDNA sequence for clone #26994.
SEQ ID NO:306 is the determined cDNA sequence for clone #26995.
SEQ ID NO:307 is the determined cDNA sequence for clone #27003.
SEQ ID NO:308 is the determined cDNA sequence for clone #27005.
SEQ ID NO:309 is the determined cDNA sequence for clone #27010.
SEQ ID NO:310 is the determined cDNA sequence for clone #27011.
SEQ ID NO:311 is the determined cDNA sequence for clone #27013.
SEQ ID NO:312 is the determined cDNA sequence for clone #27016
SEQ ID NO:313 is the determined cDNA sequence for clone #27017.
SEQ ID NO:314 is the determined cDNA sequence for clone #27019.
SEQ ID NO:315 is the determined cDNA sequence for clone #27028.
SEQ ID NO:316 is the full-length cDNA sequence for clone #19060.
SEQ ID NO:317 is the full-length cDNA sequence for clone #18964.
SEQ ID NO:318 is the full-length cDNA sequence for clone #18929.
SEQ ID NO:319 is the full-length cDNA sequence for clone #18991.
SEQ ID NO:320 is the full-length cDNA sequence for clone #18996.
SEQ ID NO:321 is the full-length cDNA sequence for clone #18966.
SEQ ID NO:322 is the full-length cDNA sequence for clone #18951.
SEQ ID NO:323 is the full-length cDNA sequence for clone #18973 (also known as L516S).
SEQ ID NO:324 is the amino acid sequence for clone #19060.
SEQ ID NO:325 is the amino acid sequence for clone #19063.
SEQ ID NO:326 is the amino acid sequence for clone #19077.
SEQ ID NO:327 is the amino acid sequence for clone #19110.
SEQ ID NO:328 is the amino acid sequence for clone #19122.
SEQ ID NO:329 is the amino acid sequence for clone #19118.
SEQ ID NO:330 is the amino acid sequence for clone #19080.
SEQ ID NO:331 is the amino acid sequence for clone #19127.
SEQ ID NO:332 is the amino acid sequence for clone #19117.
SEQ ID NO:333 is the amino acid sequence for clone #19095, also referred to L549S.
SEQ ID NO:334 is the amino acid sequence for clone #18964.
SEQ ID NO:335 is the amino acid sequence for clone #18929.
SEQ ID NO:336 is the amino acid sequence for clone #18991.
SEQ ID NO:337 is the amino acid sequence for clone #18996.

SEQ ID NO:338 is the amino acid sequence for clone #18966.

SEQ ID NO:339 is the amino acid sequence for clone #18951.

SEQ ID NO:340 is the amino acid sequence for clone #18973.

SEQ ID NO:341 is the determined cDNA sequence for clone 26461.

SEQ ID NO:342 is the determined cDNA sequence for clone 26462.

SEQ ID NO:343 is the determined cDNA sequence for clone 26463.

SEQ ID NO:344 is the determined cDNA sequence for clone 26464.

SEQ ID NO:345 is the determined cDNA sequence for clone 26465.

SEQ ID NO:346 is the determined cDNA sequence for clone 26466.

SEQ ID NO:347 is the determined cDNA sequence for clone 26467.

SEQ ID NO:348 is the determined cDNA sequence for clone 26468.

SEQ ID NO:349 is the determined cDNA sequence for clone 26469.

SEQ ID NO:350 is the determined cDNA sequence for clone 26470.

SEQ ID NO:351 is the determined cDNA sequence for clone 26471.

SEQ ID NO:352 is the determined cDNA sequence for clone 26472.

SEQ ID NO:353 is the determined cDNA sequence for clone 26474.

SEQ ID NO:354 is the determined cDNA sequence for clone 26475.

SEQ ID NO:355 is the determined cDNA sequence for clone 26476.

SEQ ID NO:356 is the determined cDNA sequence for clone 26477.

SEQ ID NO:357 is the determined cDNA sequence for clone 26478.

SEQ ID NO:358 is the determined cDNA sequence for clone 26479.

SEQ ID NO:359 is the determined cDNA sequence for clone 26480.

SEQ ID NO:360 is the determined cDNA sequence for clone 26481.

SEQ ID NO:361 is the determined cDNA sequence for clone 26482

SEQ ID NO:362 is the determined cDNA sequence for clone 26483.

SEQ ID NO:363 is the determined cDNA sequence for clone 26484.

SEQ ID NO:364 is the determined cDNA sequence for clone 26485.

SEQ ID NO:365 is the determined cDNA sequence for clone 26486.

SEQ ID NO:366 is the determined cDNA sequence for clone 26487.

SEQ ID NO:367 is the determined cDNA sequence for clone 26488.

SEQ ID NO:368 is the determined cDNA sequence for clone 26489.

SEQ ID NO:369 is the determined cDNA sequence for clone 26490.

SEQ ID NO:370 is the determined cDNA sequence for clone 26491.

SEQ ID NO:371 is the determined cDNA sequence for clone 26492.

SEQ ID NO:372 is the determined cDNA sequence for clone 26493.

SEQ ID NO:373 is the determined cDNA sequence for clone 26494.

SEQ ID NO:374 is the determined cDNA sequence for clone 26495.

SEQ ID NO:375 is the determined cDNA sequence for clone 26496.

SEQ ID NO:376 is the determined cDNA sequence for clone 26497.

SEQ ID NO:377 is the determined cDNA sequence for clone 26498.

SEQ ID NO:378 is the determined cDNA sequence for clone 26499.

SEQ ID NO:379 is the determined cDNA sequence for clone 26500.

SEQ ID NO:380 is the determined cDNA sequence for clone 26501.

SEQ ID NO:381 is the determined cDNA sequence for clone 26502.

SEQ ID NO:382 is the determined cDNA sequence for clone 26503.

SEQ ID NO:383 is the determined cDNA sequence for clone 26504.

SEQ ID NO:384 is the determined cDNA sequence for clone 26505.

SEQ ID NO:385 is the determined cDNA sequence for clone 26506.

SEQ ID NO:386 is the determined cDNA sequence for clone 26507.

SEQ ID NO:387 is the determined cDNA sequence for clone 26508.

SEQ ID NO:388 is the determined cDNA sequence for clone 26509.

SEQ ID NO:389 is the determined cDNA sequence for clone 26511.

SEQ ID NO:390 is the determined cDNA sequence for clone 26513.

SEQ ID NO:391 is the determined cDNA sequence for clone 26514.

SEQ ID NO:392 is the determined cDNA sequence for clone 26515.

SEQ ID NO:393 is the determined cDNA sequence for clone 26516.

SEQ ID NO:394 is the determined cDNA sequence for clone 26517.

SEQ ID NO:395 is the determined cDNA sequence for clone 26518.

SEQ ID NO:396 is the determined cDNA sequence for clone 26519.

SEQ ID NO:397 is the determined cDNA sequence for clone 26520.

SEQ ID NO:398 is the determined cDNA sequence for clone 26521.

SEQ ID NO:399 is the determined cDNA sequence for clone 26522.

SEQ ID NO:400 is the determined cDNA sequence for clone 26523.

SEQ ID NO:401 is the determined cDNA sequence for clone 26524.

SEQ ID NO:402 is the determined cDNA sequence for clone 26526.

SEQ ID NO:403 is the determined cDNA sequence for clone 26527.

SEQ ID NO:404 is the determined cDNA sequence for clone 26528.
SEQ ID NO:405 is the determined cDNA sequence for clone 26529.
SEQ ID NO:406 is the determined cDNA sequence for clone 26530.
SEQ ID NO:407 is the determined cDNA sequence for clone 26532.
SEQ ID NO:408 is the determined cDNA sequence for clone 26533.
SEQ ID NO:409 is the determined cDNA sequence for clone 26534.
SEQ ID NO:410 is the determined cDNA sequence for clone 26535.
SEQ ID NO:411 is the determined cDNA sequence for clone 26536.
SEQ ID NO:412 is the determined cDNA sequence for clone 26537.
SEQ ID NO:413 is the determined cDNA sequence for clone 26538.
SEQ ID NO:414 is the determined cDNA sequence for clone 26540.
SEQ ID NO:415 is the determined cDNA sequence for clone 26541.
SEQ ID NO:416 is the determined cDNA sequence for clone 26542.
SEQ ID NO:417 is the determined cDNA sequence for clone 26543.
SEQ ID NO:418 is the determined cDNA sequence for clone 26544.
SEQ ID NO:419 is the determined cDNA sequence for clone 26546.
SEQ ID NO:420 is the determined cDNA sequence for clone 26547.
SEQ ID NO:421 is the determined cDNA sequence for clone 26548.
SEQ ID NO:422 is the determined cDNA sequence for clone 26549.
SEQ ID NO:423 is the determined cDNA sequence for clone 26550.
SEQ ID NO:424 is the determined cDNA sequence for clone 26551.
SEQ ID NO:425 is the determined cDNA sequence for clone 26552.
SEQ ID NO:426 is the determined cDNA sequence for clone 26553.
SEQ ID NO:427 is the determined cDNA sequence for clone 26554.
SEQ ID NO:428 is the determined cDNA sequence for clone 26556.
SEQ ID NO:429 is the determined cDNA sequence for clone 26557.
SEQ ID NO:430 is the determined cDNA sequence for clone 27631.
SEQ ID NO:431 is the determined cDNA sequence for clone 27632.
SEQ ID NO:432 is the determined cDNA sequence for clone 27633.
SEQ ID NO:433 is the determined cDNA sequence for clone 27635.
SEQ ID NO:434 is the determined cDNA sequence for clone 27636.
SEQ ID NO:435 is the determined cDNA sequence for clone 27637.
SEQ ID NO:436 is the determined cDNA sequence for clone 27638.
SEQ ID NO:437 is the determined cDNA sequence for clone 27639.
SEQ ID NO:438 is the determined cDNA sequence for clone 27640.
SEQ ID NO:439 is the determined cDNA sequence for clone 27641.
SEQ ID NO:440 is the determined cDNA sequence for clone 27642.
SEQ ID NO:441 is the determined cDNA sequence for clone 27644.
SEQ ID NO:442 is the determined cDNA sequence for clone 27646.
SEQ ID NO:443 is the determined cDNA sequence for clone 27647.
SEQ ID NO:444 is the determined cDNA sequence for clone 27649.
SEQ ID NO:445 is the determined cDNA sequence for clone 27650.
SEQ ID NO:446 is the determined cDNA sequence for clone 27651.
SEQ ID NO:447 is the determined cDNA sequence for clone 27652.
SEQ ID NO:448 is the determined cDNA sequence for clone 27654.
SEQ ID NO:449 is the determined cDNA sequence for clone 27655.
SEQ ID NO:450 is the determined cDNA sequence for clone 27657.
SEQ ID NO:451 is the determined cDNA sequence for clone 27659.
SEQ ID NO:452 is the determined cDNA sequence for clone 27665.
SEQ ID NO:453 is the determined cDNA sequence for clone 27666.
SEQ ID NO:454 is the determined cDNA sequence for clone 27668.
SEQ ID NO:455 is the determined cDNA sequence for clone 27670.
SEQ ID NO:456 is the determined cDNA sequence for clone 27671.
SEQ ID NO:457 is the determined cDNA sequence for clone 27672.
SEQ ID NO:458 is the determined cDNA sequence for clone 27674.
SEQ ID NO:459 is the determined cDNA sequence for clone 27677.
SEQ ID NO:460 is the determined cDNA sequence for clone 27681.
SEQ ID NO:461 is the determined cDNA sequence for clone 27682.
SEQ ID NO:462 is the determined cDNA sequence for clone 27683.
SEQ ID NO:463 is the determined cDNA sequence for clone 27686.
SEQ ID NO:464 is the determined cDNA sequence for clone 27688.
SEQ ID NO:465 is the determined cDNA sequence for clone 27689.
SEQ ID NO:466 is the determined cDNA sequence for clone 27690.
SEQ ID NO:467 is the determined cDNA sequence for clone 27693.
SEQ ID NO:468 is the determined cDNA sequence for clone 27699.
SEQ ID NO:469 is the determined cDNA sequence for clone 27700.

SEQ ID NO:470 is the determined cDNA sequence for clone 27702.
SEQ ID NO:471 is the determined cDNA sequence for clone 27705.
SEQ ID NO:472 is the determined cDNA sequence for clone 27706.
SEQ ID NO:473 is the determined cDNA sequence for clone 27707.
SEQ ID NO:474 is the determined cDNA sequence for clone 27708.
SEQ ID NO:475 is the determined cDNA sequence for clone 27709.
SEQ ID NO:476 is the determined cDNA sequence for clone 27710.
SEQ ID NO:477 is the determined cDNA sequence for clone 27711.
SEQ ID NO:478 is the determined cDNA sequence for clone 27712.
SEQ ID NO:479 is the determined cDNA sequence for clone 27713.
SEQ ID NO:480 is the determined cDNA sequence for clone 27714.
SEQ ID NO:481 is the determined cDNA sequence for clone 27715.
SEQ ID NO:482 is the determined cDNA sequence for clone 27716.
SEQ ID NO:483 is the determined cDNA sequence for clone 27717.
SEQ ID NO:484 is the determined cDNA sequence for clone 27718.
SEQ ID NO:485 is the determined cDNA sequence for clone 27719.
SEQ ID NO:486 is the determined cDNA sequence for clone 27720.
SEQ ID NO:487 is the determined cDNA sequence for clone 27722.
SEQ ID NO:488 is the determined cDNA sequence for clone 27723.
SEQ ID NO:489 is the determined cDNA sequence for clone 27724.
SEQ ID NO:490 is the determined cDNA sequence for clone 27726.
SEQ ID NO:491 is the determined cDNA sequence for clone 25015.
SEQ ID NO:492 is the determined cDNA sequence for clone 25016.
SEQ ID NO:493 is the determined cDNA sequence for clone 25017.
SEQ ID NO:494 is the determined cDNA sequence for clone 25018
SEQ ID NO:495 is the determined cDNA sequence for clone 25030.
SEQ ID NO:496 is the determined cDNA sequence for clone 25033.
SEQ ID NO:497 is the determined cDNA sequence for clone 25034.
SEQ ID NO:498 is the determined cDNA sequence for clone 25035.
SEQ ID NO:499 is the determined cDNA sequence for clone 25036.
SEQ ID NO:500 is the determined cDNA sequence for clone 25037.
SEQ ID NO:501 is the determined cDNA sequence for clone 25038.
SEQ ID NO:502 is the determined cDNA sequence for clone 25039.
SEQ ID NO:503 is the determined cDNA sequence for clone 25040.
SEQ ID NO:504 is the determined cDNA sequence for clone 25042.
SEQ ID NO:505 is the determined cDNA sequence for clone 25043.
SEQ ID NO:506 is the determined cDNA sequence for clone 25044.
SEQ ID NO:507 is the determined cDNA sequence for clone 25045.
SEQ ID NO:508 is the determined cDNA sequence for clone 25047.
SEQ ID NO:509 is the determined cDNA sequence for clone 25048.
SEQ ID NO:510 is the determined cDNA sequence for clone 25049.
SEQ ID NO:511 is the determined cDNA sequence for clone 25185.
SEQ ID NO:512 is the determined cDNA sequence for clone 25186.
SEQ ID NO:513 is the determined cDNA sequence for clone 25187.
SEQ ID NO:514 is the determined cDNA sequence for clone 25188.
SEQ ID NO:515 is the determined cDNA sequence for clone 25189.
SEQ ID NO:516 is the determined cDNA sequence for clone 25190.
SEQ ID NO:517 is the determined cDNA sequence for clone 25193.
SEQ ID NO:518 is the determined cDNA sequence for clone 25194.
SEQ ID NO:519 is the determined cDNA sequence for clone 25196.
SEQ ID NO:520 is the determined cDNA sequence for clone 25198.
SEQ ID NO:521 is the determined cDNA sequence for clone 25199.
SEQ ID NO:522 is the determined cDNA sequence for clone 25200.
SEQ ID NO:523 is the determined cDNA sequence for clone 25202.
SEQ ID NO:524 is the determined cDNA sequence for clone 25364.
SEQ ID NO:525 is the determined cDNA sequence for clone 25366.
SEQ ID NO:526 is the determined cDNA sequence for clone 25367.
SEQ ID NO:527 is the determined cDNA sequence for clone 25368.
SEQ ID NO:528 is the determined cDNA sequence for clone 25369.
SEQ ID NO:529 is the determined cDNA sequence for clone 25370.
SEQ ID NO:530 is the determined cDNA sequence for clone 25371.
SEQ ID NO:531 is the determined cDNA sequence for clone 25372.
SEQ ID NO:532 is the determined cDNA sequence for clone 25373.
SEQ ID NO:533 is the determined cDNA sequence for clone 25374.
SEQ ID NO:534 is the determined cDNA sequence for clone 25376.
SEQ ID NO:535 is the determined cDNA sequence for clone 25377.

SEQ ID NO:536 is the determined cDNA sequence for clone 25378.
SEQ ID NO:537 is the determined cDNA sequence for clone 25379.
SEQ ID NO:538 is the determined cDNA sequence for clone 25380.
SEQ ID NO:539 is the determined cDNA sequence for clone 25381.
SEQ ID NO:540 is the determined cDNA sequence for clone 25382.
SEQ ID NO:541 is the determined cDNA sequence for clone 25383.
SEQ ID NO:542 is the determined cDNA sequence for clone 25385.
SEQ ID NO:543 is the determined cDNA sequence for clone 25386.
SEQ ID NO:544 is the determined cDNA sequence for clone 25387.
SEQ ID NO:545 is the determined cDNA sequence for clone 26013.
SEQ ID NO:546 is the determined cDNA sequence for clone 26014.
SEQ ID NO:547 is the determined cDNA sequence for clone 26016.
SEQ ID NO:548 is the determined cDNA sequence for clone 26017.
SEQ ID NO:549 is the determined cDNA sequence for clone 26018.
SEQ ID NO:550 is the determined cDNA sequence for clone 26019.
SEQ ID NO:551 is the determined cDNA sequence for clone 26020.
SEQ ID NO:552 is the determined cDNA sequence for clone 26021.
SEQ ID NO:553 is the determined cDNA sequence for clone 26022.
SEQ ID NO:554 is the determined cDNA sequence for clone 26027.
SEQ ID NO:555 is the determined cDNA sequence for clone 26197.
SEQ ID NO:556 is the determined cDNA sequence for clone 26199.
SEQ ID NO:557 is the determined cDNA sequence for clone 26201.
SEQ ID NO:558 is the determined cDNA sequence for clone 26202.
SEQ ID NO:559 is the determined cDNA sequence for clone 26203.
SEQ ID NO:560 is the determined cDNA sequence for clone 26204.
SEQ ID NO:561 is the determined cDNA sequence for clone 26205.
SEQ ID NO:562 is the determined cDNA sequence for clone 26206.
SEQ ID NO:563 is the determined cDNA sequence for clone 26208.
SEQ ID NO:564 is the determined cDNA sequence for clone 26211.
SEQ ID NO:565 is the determined cDNA sequence for clone 26212.
SEQ ID NO:566 is the determined cDNA sequence for clone 26213.
SEQ ID NO:567 is the determined cDNA sequence for clone 26214.
SEQ ID NO:568 is the determined cDNA sequence for clone 26215.
SEQ ID NO:569 is the determined cDNA sequence for clone 26216.
SEQ ID NO:570 is the determined cDNA sequence for clone 26217.
SEQ ID NO:571 is the determined cDNA sequence for clone 26218.
SEQ ID NO:572 is the determined cDNA sequence for clone 26219.
SEQ ID NO:573 is the determined cDNA sequence for clone 26220.
SEQ ID NO:574 is the determined cDNA sequence for clone 26221.
SEQ ID NO:575 is the determined cDNA sequence for clone 26224.
SEQ ID NO:576 is the determined cDNA sequence for clone 26225.
SEQ ID NO:577 is the determined cDNA sequence for clone 26226.
SEQ ID NO:578 is the determined cDNA sequence for clone 26227.
SEQ ID NO:579 is the determined cDNA sequence for clone 26228.
SEQ ID NO:580 is the determined cDNA sequence for clone 26230.
SEQ ID NO:581 is the determined cDNA sequence for clone 26231.
SEQ ID NO:582 is the determined cDNA sequence for clone 26234.
SEQ ID NO:583 is the determined cDNA sequence for clone 26236.
SEQ ID NO:584 is the determined cDNA sequence for clone 26237.
SEQ ID NO:585 is the determined cDNA sequence for clone 26239.
SEQ ID NO:586 is the determined cDNA sequence for clone 26240.
SEQ ID NO:587 is the determined cDNA sequence for clone 26241.
SEQ ID NO:588 is the determined cDNA sequence for clone 26242.
SEQ ID NO:589 is the determined cDNA sequence for clone 26246.
SEQ ID NO:590 is the determined cDNA sequence for clone 26247.
SEQ ID NO:591 is the determined cDNA sequence for clone 26248.
SEQ ID NO:592 is the determined cDNA sequence for clone 26249.
SEQ ID NO:593 is the determined cDNA sequence for clone 26250.
SEQ ID NO:594 is the determined cDNA sequence for clone 26251.
SEQ ID NO:595 is the determined cDNA sequence for clone 26252.
SEQ ID NO:596 is the determined cDNA sequence for clone 26253.
SEQ ID NO:597 is the determined cDNA sequence for clone 26254.
SEQ ID NO:598 is the determined cDNA sequence for clone 26255.
SEQ ID NO:599 is the determined cDNA sequence for clone 26256.
SEQ ID NO:600 is the determined cDNA sequence for clone 26257.
SEQ ID NO:601 is the determined cDNA sequence for clone 26259.

SEQ ID NO:602 is the determined cDNA sequence for clone 26260.
SEQ ID NO:603 is the determined cDNA sequence for clone 26261.
SEQ ID NO:604 is the determined cDNA sequence for clone 26262.
SEQ ID NO:605 is the determined cDNA sequence for clone 26263.
SEQ ID NO:606 is the determined cDNA sequence for clone 26264.
SEQ ID NO:607 is the determined cDNA sequence for clone 26265.
SEQ ID NO:608 is the determined cDNA sequence for clone 26266.
SEQ ID NO:609 is the determined cDNA sequence for clone 26268.
SEQ ID NO:610 is the determined cDNA sequence for clone 26269.
SEQ ID NO:611 is the determined cDNA sequence for clone 26271.
SEQ ID NO:612 is the determined cDNA sequence for clone 26273.
SEQ ID NO:613 is the determined cDNA sequence for clone 26810.
SEQ ID NO:614 is the determined cDNA sequence for clone 26811.
SEQ ID NO:615 is the determined cDNA sequence for clone 26812.1.
SEQ ID NO:616 is the determined cDNA sequence for clone 26812.2.
SEQ ID NO:617 is the determined cDNA sequence for clone 26813.
SEQ ID NO:618 is the determined cDNA sequence for clone 26814.
SEQ ID NO:619 is the determined cDNA sequence for clone 26815.
SEQ ID NO:620 is the determined cDNA sequence for clone 26816.
SEQ ID NO:621 is the determined cDNA sequence for clone 26818.
SEQ ID NO:622 is the determined cDNA sequence for clone 26819.
SEQ ID NO:623 is the determined cDNA sequence for clone 26820.
SEQ ID NO:624 is the determined cDNA sequence for clone 26821.
SEQ ID NO:625 is the determined cDNA sequence for clone 26822.
SEQ ID NO:626 is the determined cDNA sequence for clone 26824.
SEQ ID NO:627 is the determined cDNA sequence for clone 26825.
SEQ ID NO:628 is the determined cDNA sequence for clone 26826.
SEQ ID NO:629 is the determined cDNA sequence for clone 26827.
SEQ ID NO:630 is the determined cDNA sequence for clone 26829.
SEQ ID NO:631 is the determined cDNA sequence for clone 26830.
SEQ ID NO:632 is the determined cDNA sequence for clone 26831.
SEQ ID NO:633 is the determined cDNA sequence for clone 26832.
SEQ ID NO:634 is the determined cDNA sequence for clone 26835.
SEQ ID NO:635 is the determined cDNA sequence for clone 26836.
SEQ ID NO:636 is the determined cDNA sequence for clone 26837.
SEQ ID NO:637 is the determined cDNA sequence for clone 26839.
SEQ ID NO:638 is the determined cDNA sequence for clone 26841.
SEQ ID NO:639 is the determined cDNA sequence for clone 26843.
SEQ ID NO:640 is the determined cDNA sequence for clone 26844.
SEQ ID NO:641 is the determined cDNA sequence for clone 26845.
SEQ ID NO:642 is the determined cDNA sequence for clone 26846.
SEQ ID NO:643 is the determined cDNA sequence for clone 26847.
SEQ ID NO:644 is the determined cDNA sequence for clone 26848.
SEQ ID NO:645 is the determined cDNA sequence for clone 26849.
SEQ ID NO:646 is the determined cDNA sequence for clone 26850.
SEQ ID NO:647 is the determined cDNA sequence for clone 26851.
SEQ ID NO:648 is the determined cDNA sequence for clone 26852.
SEQ ID NO:649 is the determined cDNA sequence for clone 26853.
SEQ ID NO:650 is the determined cDNA sequence for clone 26854.
SEQ ID NO:651 is the determined cDNA sequence for clone 26856.
SEQ ID NO:652 is the determined cDNA sequence for clone 26857.
SEQ ID NO:653 is the determined cDNA sequence for clone 26858.
SEQ ID NO:654 is the determined cDNA sequence for clone 26859.
SEQ ID NO:655 is the determined cDNA sequence for clone 26860.
SEQ ID NO:656 is the determined cDNA sequence for clone 26862.
SEQ ID NO:657 is the determined cDNA sequence for clone 26863.
SEQ ID NO:658 is the determined cDNA sequence for clone 26864.
SEQ ID NO:659 is the determined cDNA sequence for clone 26865.
SEQ ID NO:660 is the determined cDNA sequence for clone 26867.
SEQ ID NO:661 is the determined cDNA sequence for clone 26868.
SEQ ID NO:662 is the determined cDNA sequence for clone 26871.
SEQ ID NO:663 is the determined cDNA sequence for clone 26873.
SEQ ID NO:664 is the determined cDNA sequence for clone 26875.
SEQ ID NO:665 is the determined cDNA sequence for clone 26876.
SEQ ID NO:666 is the determined cDNA sequence for clone 26877.
SEQ ID NO:667 is the determined cDNA sequence for clone 26878.

SEQ ID NO:668 is the determined cDNA sequence for clone 26880.
SEQ ID NO:669 is the determined cDNA sequence for clone 26882.
SEQ ID NO:670 is the determined cDNA sequence for clone 26883.
SEQ ID NO:671 is the determined cDNA sequence for clone 26884.
SEQ ID NO:672 is the determined cDNA sequence for clone 26885.
SEQ ID NO:673 is the determined cDNA sequence for clone 26886.
SEQ ID NO:674 is the determined cDNA sequence for clone 26887.
SEQ ID NO:675 is the determined cDNA sequence for clone 26888.
SEQ ID NO:676 is the determined cDNA sequence for clone 26889.
SEQ ID NO:677 is the determined cDNA sequence for clone 26890.
SEQ ID NO:678 is the determined cDNA sequence for clone 26892.
SEQ ID NO:679 is the determined cDNA sequence for clone 26894.
SEQ ID NO:680 is the determined cDNA sequence for clone 26895.
SEQ ID NO:681 is the determined cDNA sequence for clone 26897.
SEQ ID NO:682 is the determined cDNA sequence for clone 26898.
SEQ ID NO:683 is the determined cDNA sequence for clone 26899.
SEQ ID NO:684 is the determined cDNA sequence for clone 26900.
SEQ ID NO:685 is the determined cDNA sequence for clone 26901.
SEQ ID NO:686 is the determined cDNA sequence for clone 26903.
SEQ ID NO:687 is the determined cDNA sequence for clone 26905.
SEQ ID NO:688 is the determined cDNA sequence for clone 26906.
SEQ ID NO:689 is the determined cDNA sequence for clone 26708.
SEQ ID NO:690 is the determined cDNA sequence for clone 26709.
SEQ ID NO:691 is the determined cDNA sequence for clone 26710.
SEQ ID NO:692 is the determined cDNA sequence for clone 26711.
SEQ ID NO:693 is the determined cDNA sequence for clone 26712.
SEQ ID NO:694 is the determined cDNA sequence for clone 26713.
SEQ ID NO:695 is the determined cDNA sequence for clone 26714.
SEQ ID NO:696 is the determined cDNA sequence for clone 26715.
SEQ ID NO:697 is the determined cDNA sequence for clone 26716.
SEQ ID NO:698 is the determined cDNA sequence for clone 26717.
SEQ ID NO:699 is the determined cDNA sequence for clone 26718.
SEQ ID NO:700 is the determined cDNA sequence for clone 26719.
SEQ ID NO:701 is the determined cDNA sequence for clone 26720.
SEQ ID NO:702 is the determined cDNA sequence for clone 26721.
SEQ ID NO:703 is the determined cDNA sequence for clone 26722.
SEQ ID NO:704 is the determined cDNA sequence for clone 26723.
SEQ ID NO:705 is the determined cDNA sequence for clone 26724.
SEQ ID NO:706 is the determined cDNA sequence for clone 26725.
SEQ ID NO:707 is the determined cDNA sequence for clone 26726.
SEQ ID NO:708 is the determined cDNA sequence for clone 26727.
SEQ ID NO:709 is the determined cDNA sequence for clone 26728.
SEQ ID NO:710 is the determined cDNA sequence for clone 26729.
SEQ ID NO:711 is the determined cDNA sequence for clone 26730.
SEQ ID NO:712 is the determined cDNA sequence for clone 26731.
SEQ ID NO:713 is the determined cDNA sequence for clone 26732.
SEQ ID NO:714 is the determined cDNA sequence for clone 26733.1.
SEQ ID NO:715 is the determined cDNA sequence for clone 26733.2.
SEQ ID NO:716 is the determined cDNA sequence for clone 26734.
SEQ ID NO:717 is the determined cDNA sequence for clone 26735.
SEQ ID NO:718 is the determined cDNA sequence for clone 26736.
SEQ ID NO:719 is the determined cDNA sequence for clone 26737.
SEQ ID NO:720 is the determined cDNA sequence for clone 26738.
SEQ ID NO:721 is the determined cDNA sequence for clone 26739.
SEQ ID NO:722 is the determined cDNA sequence for clone 26741.
SEQ ID NO:723 is the determined cDNA sequence for clone 26742.
SEQ ID NO:724 is the determined cDNA sequence for clone 26743.
SEQ ID NO:725 is the determined cDNA sequence for clone 26744.
SEQ ID NO:726 is the determined cDNA sequence for clone 26745.
SEQ ID NO:727 is the determined cDNA sequence for clone 26746.
SEQ ID NO:728 is the determined cDNA sequence for clone 26747.
SEQ ID NO:729 is the determined cDNA sequence for clone 26748.
SEQ ID NO:730 is the determined cDNA sequence for clone 26749.
SEQ ID NO:731 is the determined cDNA sequence for clone 26750.
SEQ ID NO:732 is the determined cDNA sequence for clone 26751.
SEQ ID NO:733 is the determined cDNA sequence for clone 26752.

SEQ ID NO:734 is the determined cDNA sequence for clone 26753.
SEQ ID NO:735 is the determined cDNA sequence for clone 26754.
SEQ ID NO:736 is the determined cDNA sequence for clone 26755.
SEQ ID NO:737 is the determined cDNA sequence for clone 26756.
SEQ ID NO:738 is the determined cDNA sequence for clone 26757.
SEQ ID NO:739 is the determined cDNA sequence for clone 26758.
SEQ ID NO:740 is the determined cDNA sequence for clone 26759.
SEQ ID NO:741 is the determined cDNA sequence for clone 26760.
SEQ ID NO:742 is the determined cDNA sequence for clone 26761.
SEQ ID NO:743 is the determined cDNA sequence for clone 26762.
SEQ ID NO:744 is the determined cDNA sequence for clone 26763.
SEQ ID NO:745 is the determined cDNA sequence for clone 26764.
SEQ ID NO:746 is the determined cDNA sequence for clone 26765.
SEQ ID NO:747 is the determined cDNA sequence for clone 26766.
SEQ ID NO:748 is the determined cDNA sequence for clone 26767.
SEQ ID NO:749 is the determined cDNA sequence for clone 26768.
SEQ ID NO:750 is the determined cDNA sequence for clone 26769.
SEQ ID NO:751 is the determined cDNA sequence for clone 26770.
SEQ ID NO:752 is the determined cDNA sequence for clone 26771.
SEQ ID NO:753 is the determined cDNA sequence for clone 26772.
SEQ ID NO:754 is the determined cDNA sequence for clone 26773.
SEQ ID NO:755 is the determined cDNA sequence for clone 26774.
SEQ ID NO:756 is the determined cDNA sequence for clone 26775.
SEQ ID NO:757 is the determined cDNA sequence for clone 26776.
SEQ ID NO:758 is the determined cDNA sequence for clone 26777.
SEQ ID NO:759 is the determined cDNA sequence for clone 26778.
SEQ ID NO:760 is the determined cDNA sequence for clone 26779.
SEQ ID NO:761 is the determined cDNA sequence for clone 26781.
SEQ ID NO:762 is the determined cDNA sequence for clone 26782.
SEQ ID NO:763 is the determined cDNA sequence for clone 26783.
SEQ ID NO:764 is the determined cDNA sequence for clone 26784.
SEQ ID NO:765 is the determined cDNA sequence for clone 26785.
SEQ ID NO:766 is the determined cDNA sequence for clone 26786.
SEQ ID NO:767 is the determined cDNA sequence for clone 26787.
SEQ ID NO:768 is the determined cDNA sequence for clone 26788.
SEQ ID NO:769 is the determined cDNA sequence for clone 26790.
SEQ ID NO:770 is the determined cDNA sequence for clone 26791.
SEQ ID NO:771 is the determined cDNA sequence for clone 26792.
SEQ ID NO:772 is the determined cDNA sequence for clone 26793.
SEQ ID NO:773 is the determined cDNA sequence for clone 26794.
SEQ ID NO:774 is the determined cDNA sequence for clone 26795.
SEQ ID NO:775 is the determined cDNA sequence for clone 26796.
SEQ ID NO:776 is the determined cDNA sequence for clone 26797.
SEQ ID NO:777 is the determined cDNA sequence for clone 26798.
SEQ ID NO:778 is the determined cDNA sequence for clone 26800.
SEQ ID NO:779 is the determined cDNA sequence for clone 26801.
SEQ ID NO:780 is the determined cDNA sequence for clone 26802.
SEQ ID NO:781 is the determined cDNA sequence for clone 26803.
SEQ ID NO:782 is the determined cDNA sequence for clone 26804.
SEQ ID NO:783 is the amino acid sequence for L773P.
SEQ ID NO:784 is the determined DNA sequence of the L773P expression construct.
SEQ ID NO:785 is the determined DNA sequence of the L773PA expression construct.
SEQ ID NO:786 is a predicted amino acid sequence for L552S.
SEQ ID NO:787 is a predicted amino acid sequence for L840P.
SEQ ID NO:788 is the full-length cDNA sequence for L548S.
SEQ ID NO:789 is the amino acid sequence encoded by SEQ ID NO:788.
SEQ ID NO:790 is an extended cDNA sequence for L552S.
SEQ ID NO:791 is the predicted amino acid sequence encoded by the cDNA sequence of SEQ ID NO:790.
SEQ ID NO:792 is the determined cDNA sequence for an isoform of L552S.
SEQ ID NO:793 is the predicted amino acid sequence encoded by SEQ ID NO:792.
SEQ ID NO:794 is an extended cDNA sequence for L840P.
SEQ ID NO:795 is the predicted amino acid sequence encoded by SEQ DI NO:794.
SEQ ID NO:796 is an extended cDNA sequence for L801P.
SEQ ID NO:797 is a first predicted amino acid sequence encoded by SEQ ID NO:796.
SEQ ID NO:798 is a second predicted amino acid sequence encoded by SEQ ID NO:796.
SEQ ID NO:799 is a third predicted amino acid sequence encoded by SEQ ID NO:796.
SEQ ID NO:800 is the determined full-length sequence for L844P.
SEQ ID NO:801 is the 5' consensus cDNA sequence for L551S.

SEQ ID NO:802 is the 3' consensus cDNA sequence for L551S.

SEQ ID NO:803 is the cDNA sequence for STY8.

SEQ ID NO:804 is an extended cDNA sequence for L551S.

SEQ ID NO:805 is the amino acid sequence for STY8.

SEQ ID NO:806 is the extended amino acid sequence for L551S.

SEQ ID NO:807 is the determined full length cDNA sequence for L773P.

SEQ ID NO:808 is the full-length cDNA sequence of L552S.

SEQ ID NO:809 is the full-length amino acid sequence of L552S.

SEQ ID NO:810 is the determined cDNA sequence of clone 50989.

SEQ ID NO:811 is the determined cDNA sequence of clone 50990.

SEQ ID NO:812 is the determined cDNA sequence of clone 50992.

SEQ ID NO:813-824 are the determined cDNA sequences for clones isolated from lung tumor tissue.

SEQ ID NO:825 is the determined cDNA sequence for the full-length L551 clone 54305.

SEQ ID NO:826 is the determined cDNA sequence for the full-length L551S clone 54298.

SEQ ID NO:827 is the full-length amino acid sequence for L551S.

Tables 1-6 contain the sequence identifiers for SEQ ID NO:828-1664.

TABLE 1

| SEQ ID NO: | CLONE IDENTIFIER |
| --- | --- |
| 828 | R0126:A02 |
| 829 | R0126:A03 |
| 830 | R0126:A05 |
| 831 | R0126:A06 |
| 832 | R0126:A08 |
| 833 | R0126:A09 |
| 834 | R0126:A10 |
| 835 | R0126:A11 |
| 836 | R0126:A12 |
| 837 | R0126:B01 |
| 838 | R0126:B03 |
| 839 | R0126:B04 |
| 840 | R0126:B05 |
| 841 | R0126:B06 |
| 842 | R0126:B07 |
| 843 | R0126:B08 |
| 844 | R0126:B09 |
| 845 | R0126:B11 |
| 846 | R0126:B12 |
| 847 | R0126:C01 |
| 848 | R0126:C02 |
| 849 | R0126:C03 |
| 850 | R0126:C05 |
| 851 | R0126:C06 |
| 852 | R0126:C07 |
| 853 | R0126:C08 |
| 854 | R0126:C09 |
| 855 | R0126:C10 |
| 856 | R0126:C11 |
| 857 | R0126:C12 |
| 858 | R0126:D01 |
| 859 | R0126:D02 |
| 860 | R0126:D03 |
| 861 | R0126:D04 |
| 862 | R0126:D05 |
| 863 | R0126:D06 |
| 864 | R0126:D07 |
| 865 | R0126:D08 |

TABLE 1-continued

| SEQ ID NO: | CLONE IDENTIFIER |
| --- | --- |
| 866 | R0126:D09 |
| 867 | R0126:D10 |
| 868 | R0126:D11 |
| 869 | R0126:D12 |
| 870 | R0126:E01 |
| 871 | R0126:E02 |
| 872 | R0126:E03 |
| 873 | R0126:E04 |
| 874 | R0126:E05 |
| 875 | R0126:E06 |
| 876 | R0126:E07 |
| 877 | R0126:E08 |
| 878 | R0126:E09 |
| 879 | R0126:E10 |
| 880 | R0126:E11 |
| 881 | R0126:E12 |
| 882 | R0126:F01 |
| 883 | R0126:F02 |
| 884 | R0126:F03 |
| 885 | R0126:F04 |
| 886 | R0126:F05 |
| 887 | R0126:F06 |
| 888 | R0126:F07 |
| 889 | R0126:F08 |
| 890 | R0126:F10 |
| 891 | R0126:F11 |
| 892 | R0126:F12 |
| 893 | R0126:G01 |
| 894 | R0126:G02 |
| 895 | R0126:G03 |
| 896 | R0126:G04 |
| 897 | R0126:G05 |
| 898 | R0126:G06 |
| 899 | R0126:G07 |
| 900 | R0126:G09 |
| 901 | R0126:G10 |
| 902 | R0126:G11 |
| 903 | R0126:G12 |
| 904 | R0126:H01 |
| 905 | R0126:H02 |
| 906 | R0126:H03 |
| 907 | R0126:H04 |
| 908 | R0126:H05 |
| 909 | R0126:H06 |
| 910 | R0126:H07 |
| 911 | R0126:H09 |
| 912 | R0126:H10 |
| 913 | R0126:H11 |
| 914 | R0127:A02 |
| 915 | R0127:A05 |
| 916 | R0127:A06 |
| 917 | R0127:A07 |
| 918 | R0127:A08 |
| 919 | R0127:A09 |
| 920 | R0127:A10 |
| 921 | R0127:A11 |
| 922 | R0127:A12 |
| 923 | R0127:B01 |
| 924 | R0127:B03 |
| 925 | R0127:B04 |
| 926 | R0127:B05 |
| 927 | R0127:B06 |
| 928 | R0127:B07 |
| 929 | R0127:B08 |
| 930 | R0127:B09 |
| 931 | R0127:B10 |
| 932 | R0127:B11 |
| 933 | R0127:B12 |
| 934 | R0127:C01 |
| 935 | R0127:C03 |
| 936 | R0127:C04 |
| 937 | R0127:C05 |
| 938 | R0127:C07 |
| 939 | R0127:C08 |
| 940 | R0127:C09 |
| 941 | R0127:C10 |

TABLE 1-continued

| SEQ ID NO: | CLONE IDENTIFIER |
|---|---|
| 942 | R0127:C11 |
| 943 | R0127:D01 |
| 944 | R0127:D02 |
| 945 | R0127:D03 |
| 946 | R0127:D04 |
| 947 | R0127:D05 |
| 948 | R0127:D06 |
| 949 | R0127:D07 |
| 950 | R0127:D01 |
| 951 | R0127:D10 |
| 952 | R0127:D11 |
| 953 | R0127:D12 |
| 954 | R0127:E02 |
| 955 | R0127:E03 |
| 956 | R0127:E04 |
| 957 | R0127:E05 |
| 958 | R0127:E06 |
| 959 | R0127:E07 |
| 960 | R0127:E08 |
| 961 | R0127:E09 |
| 962 | R0127:E10 |
| 963 | R0127:E11 |
| 964 | R0127:F01 |
| 965 | R0127:F02 |
| 966 | R0127:F03 |
| 967 | R0127:F04 |
| 968 | R0127:F05 |
| 969 | R0127:F06 |
| 970 | R0127:F07 |
| 971 | R0127:F08 |
| 972 | R0127:F10 |
| 973 | R0127:F11 |
| 974 | R0127:F12 |
| 975 | R0127:G01 |
| 976 | R0127:G02 |
| 977 | R0127:G03 |
| 978 | R0127:G04 |
| 979 | R0127:G05 |
| 980 | R0127:G06 |
| 981 | R0127:G07 |
| 982 | R0127:G08 |
| 983 | R0127:G09 |
| 984 | R0127:G10 |
| 985 | R0127:G11 |
| 986 | R0127:G12 |
| 987 | R0127:H01 |
| 988 | R0127:H02 |
| 989 | R0127:H03 |
| 990 | R0127:H04 |
| 991 | R0127:H05 |
| 992 | R0127:H06 |
| 993 | R0127:H07 |
| 994 | R0127:H08 |
| 995 | R1027:H09 |
| 996 | R1027:H10 |
| 997 | R1027:H11 |
| 998 | R1028:A02 |
| 999 | R1028:A05 |
| 1000 | R1028:A06 |
| 1001 | R1028:A07 |
| 1002 | R1028:A08 |
| 1003 | R1028:A09 |
| 1004 | R1028:A10 |
| 1005 | R1028:B01 |
| 1006 | R1028:B02 |
| 1007 | R1028:B03 |
| 1008 | R1028:B04 |
| 1009 | R1028:B05 |
| 1010 | R1028:B08 |
| 1011 | R1028:B09 |
| 1012 | R1028:B10 |
| 1013 | R1028:B11 |
| 1014 | R1028:B12 |
| 1015 | R1028:C01 |
| 1016 | R1028:C03 |
| 1017 | R1028:C04 |
| 1018 | R1028:C05 |
| 1019 | R1028:C06 |
| 1020 | R1028:C07 |
| 1021 | R1028:C08 |
| 1022 | R1028:C10 |
| 1023 | R1028:C11 |
| 1024 | R1028:C12 |
| 1025 | R1028:D01 |
| 1026 | R1028:D02 |
| 1027 | R1028:D04 |
| 1028 | R1028:D05 |
| 1029 | R1028:D06 |
| 1030 | R1028:D07 |
| 1031 | R1028:D08 |
| 1032 | R1028:D09 |
| 1033 | R0128:D10 |
| 1034 | R0128:D11 |
| 1035 | R0128:D12 |
| 1036 | R0128:E01 |
| 1037 | R0128:E02 |
| 1038 | R0128:E03 |
| 1039 | R0128:E04 |
| 1040 | R0128:E05 |
| 1041 | R0128:E06 |
| 1042 | R0128:E07 |
| 1043 | R0128:E08 |
| 1044 | R0128:E09 |
| 1045 | R0128:E10 |
| 1046 | R0128:E12 |
| 1047 | R0128:F01 |
| 1048 | R0128:F02 |
| 1049 | R0128:F03 |
| 1050 | R0128:F04 |
| 1051 | R0128:F06 |
| 1052 | R0128:F07 |
| 1053 | R0128:F08 |
| 1054 | R0128:F09 |
| 1055 | R0128:F10 |
| 1056 | R0128:F12 |
| 1057 | R0128:G01 |
| 1058 | R0128:G02 |
| 1059 | R0128:G03 |
| 1060 | R0128:G04 |
| 1061 | R0128:G05 |
| 1062 | R0128:G06 |
| 1063 | R0128:G07 |
| 1064 | R0128:G09 |
| 1065 | R0128:G10 |
| 1066 | R0128:G11 |
| 1067 | R0128:G12 |
| 1068 | R0128:H01 |
| 1069 | R0128:H02 |
| 1070 | R0128:H03 |
| 1071 | R0128:H04 |
| 1072 | R0128:H05 |
| 1073 | R0128:H06 |
| 1074 | R0128:H07 |
| 1075 | R0128:H08 |
| 1076 | R0128:H09 |
| 1077 | R0128:H10 |
| 1078 | R0128:H11 |
| 1079 | R0130:A02 |
| 1080 | R0130:A05 |
| 1081 | R0130:A06 |
| 1082 | R0130:A08 |
| 1083 | R0130:A09 |
| 1084 | R0130:A10 |
| 1085 | R0130:A11 |
| 1086 | R0130:A12 |
| 1087 | R0130:B01 |
| 1088 | R0130:B02 |
| 1089 | R0130:B03 |
| 1090 | R0130:B04 |
| 1091 | R0130:B05 |
| 1092 | R0130:B06 |
| 1093 | R0130:B08 |

TABLE 1-continued

| SEQ ID NO: | CLONE IDENTIFIER |
|---|---|
| 1094 | R0130:B09 |
| 1095 | R0130:B10 |
| 1096 | R0130:B11 |
| 1097 | R0130:B12 |
| 1098 | R0130:C02 |
| 1099 | R0130:C03 |
| 1100 | R0130:C04 |
| 1101 | R0130:C05 |
| 1102 | R0130:C06 |
| 1103 | R0130:C07 |
| 1104 | R0130:C08 |
| 1105 | R0130:C09 |
| 1106 | R0130:C10 |
| 1107 | R0130:C11 |
| 1108 | R0130:C12 |
| 1109 | R0130:D02 |
| 1110 | R0130:D03 |
| 1111 | R0130:D04 |
| 1112 | R0130:D05 |
| 1113 | R0130:D06 |
| 1114 | R0130:D07 |
| 1115 | R0130:D09 |
| 1116 | R0130:D10 |
| 1117 | R0130:D11 |
| 1118 | R0130:D12 |
| 1119 | R0130:E01 |
| 1120 | R0130:E02 |
| 1121 | R0130:E03 |
| 1122 | R0130:E04 |
| 1123 | R0130:E05 |
| 1124 | R0130:E06 |
| 1125 | R0130:E07 |
| 1126 | R0130:E08 |
| 1127 | R0130:E09 |
| 1128 | R0130:E10 |
| 1129 | R0130:E11 |
| 1130 | R0130:E12 |
| 1131 | R0130:F02 |
| 1132 | R0130:F03 |
| 1133 | R0130:F05 |
| 1134 | R0130:F06 |
| 1135 | R0130:F07 |
| 1136 | R0130:F08 |
| 1137 | R0130:F09 |
| 1138 | R0130:F10 |
| 1139 | R0130:F11 |
| 1140 | R0130:F12 |
| 1141 | R0130:G01 |
| 1142 | R0130:G02 |
| 1143 | R0130:G03 |
| 1144 | R0130:G04 |
| 1145 | R0130:G05 |
| 1146 | R0130:G06 |
| 1147 | R0130:G07 |
| 1148 | R0130:G08 |
| 1149 | R0130:G09 |
| 1150 | R0130:G10 |
| 1151 | R0130:G11 |
| 1152 | R0130:G12 |
| 1153 | R0130:H01 |
| 1154 | R0130:H02 |
| 1155 | R0130:H04 |
| 1156 | R0130:H05 |
| 1157 | R0130:H06 |
| 1158 | R0130:H07 |
| 1159 | R0130:H08 |
| 1160 | R0130:H09 |
| 1161 | R0130:H10 |
| 1162 | R0130:H11 |
| 1163 | R0131:A02 |
| 1164 | R0131:A05 |
| 1165 | R0131:A06 |
| 1166 | R0131:A07 |
| 1167 | R0131:A08 |
| 1168 | R0131:A09 |
| 1169 | R0131:A11 |
| 1170 | R0131:A12 |
| 1171 | R0131:B02 |
| 1172 | R0131:B03 |
| 1173 | R0131:B04 |
| 1174 | R0131:B05 |
| 1175 | R0131:B07 |
| 1176 | R0131:B08 |
| 1177 | R0131:B09 |
| 1178 | R0131:B10 |
| 1179 | R0131:B11 |
| 1180 | R0131:C01 |
| 1181 | R0131:C02 |
| 1182 | R0131:C03 |
| 1183 | R0131:C04 |
| 1184 | R0131:C06 |
| 1185 | R0131:C07 |
| 1186 | R0131:C08 |
| 1187 | R0131:C10 |
| 1188 | R0131:C11 |
| 1189 | R0131:C12 |
| 1190 | R0131:D02 |
| 1191 | R0131:D03 |
| 1192 | R0131:D04 |
| 1193 | R0131:D05 |
| 1194 | R0131:D06 |
| 1195 | R0131:D07 |
| 1196 | R0131:D09 |
| 1197 | R0131:D10 |
| 1198 | R0131:D11 |
| 1199 | R0131:D12 |
| 1200 | R0131:E01 |
| 1201 | R0131:E02 |
| 1202 | R0131:E03 |
| 1203 | R0131:E04 |
| 1204 | R0131:E06 |
| 1205 | R0131:E07 |
| 1206 | R0131:E08 |
| 1207 | R0131:E10 |
| 1208 | R0131:E11 |
| 1209 | R0131:E12 |
| 1210 | R0131:F02 |
| 1211 | R0131:F04 |
| 1212 | R0131:F05 |
| 1213 | R0131:F06 |
| 1214 | R0131:F07 |
| 1215 | R0131:F08 |
| 1216 | R0131:F09 |
| 1217 | R0131:F10 |
| 1218 | R0131:F11 |
| 1219 | R0131:F12 |
| 1220 | R0131:G01 |
| 1221 | R0131:G02 |
| 1222 | R0131:G03 |
| 1223 | R0131:G04 |
| 1224 | R0131:G05 |
| 1225 | R0131:G06 |
| 1226 | R0131:G07 |
| 1227 | R0131:G08 |
| 1228 | R0131:G09 |
| 1229 | R0131:G10 |
| 1230 | R0131:G11 |
| 1231 | R0131:G12 |
| 1232 | R0131:H01 |
| 1233 | R0131:H02 |
| 1234 | R0131:H05 |
| 1235 | R0131:H06 |
| 1236 | R0131:H07 |
| 1237 | R0131:H08 |
| 1238 | R0131:H09 |
| 1239 | R0131:H11 |

TABLE 2

Clone names for NSCLC-SQL1 and corresponding SEQ ID NOs

| SEQ ID NO | CLONE IDENTIFIER |
|---|---|
| 1240 | Contig 54 |
| 1241 | Contig 55 |
| 1242 | Contig 57 |
| 1243 | Contig 58 |
| 1244 | Contig 60 |
| 1245 | Contig 62 |
| 1246 | Contig 63 |
| 1247 | Contig 64 |
| 1248 | Contig 65 |
| 1249 | Contig 66 |
| 1250 | Contig 67 |
| 1251 | Contig 68 |
| 1252 | Contig 69 |
| 1253 | Contig 70 |
| 1254 | Contig 71 |
| 1255 | Contig 72 |
| 1256 | Contig 73 |
| 1257 | Contig 74 |
| 1258 | Contig 75 |
| 1259 | Contig 77 |
| 1260 | Contig 78 |
| 1261 | Contig 79 |
| 1262 | Contig 80 |
| 1263 | Contig 81 |
| 1264 | Contig 83 |
| 1265 | Contig 84 |
| 1266 | Contig 86 |
| 1267 | Contig 87 |
| 1268 | Contig 88 |
| 1269 | Contig 89 |
| 1270 | Contig 90 |
| 1271 | Contig 91 |
| 1272 | Contig 92 |
| 1273 | Contig 94 |
| 1274 | Contig 95 |
| 1275 | Contig 96 |
| 1276 | Contig 97 |
| 1277 | Contig 98 |
| 1278 | Contig 99 |
| 1279 | Contig 100 |

TABLE 3

Clone names for NSCLC-SCLI and corresponding SEQ ID NOs

| SEQ ID NO | CLONE IDENTIFIER |
|---|---|
| 1280 | Contig 38 |
| 1281 | Contig 39 |
| 1282 | Contig 40 |
| 1283 | Contig 41 |
| 1284 | Contig 42 |
| 1285 | Contig 43 |
| 1286 | Contig 44 |
| 1287 | Contig 45 |
| 1288 | Contig 46 |
| 1289 | Contig 47 |
| 1290 | Contig 48 |
| 1291 | Contig 49 |
| 1292 | Contig 51 |
| 1293 | Contig 52 |
| 1294 | Contig 53 |
| 1295 | Contig 54 |
| 1296 | Contig 55 |
| 1297 | Contig 56 |
| 1298 | Contig 57 |
| 1299 | Contig 58 |
| 1300 | Contig 59 |
| 1301 | Contig 60 |
| 1302 | Contig 62 |
| 1303 | Contig 63 |
| 1304 | Contig 64 |
| 1305 | Contig 65 |
| 1306 | Contig 66 |
| 1307 | Contig 67 |
| 1308 | Contig 68 |
| 1309 | Contig 69 |
| 1310 | Contig 70 |
| 1311 | Contig 72 |
| 1312 | Contig 73 |
| 1313 | Contig 75 |
| 1314 | Contig 76 |
| 1315 | Contig 77 |
| 1316 | Contig 78 |
| 1317 | Contig 79 |
| 1318 | Contig 80 |
| 1319 | Contig 81 |
| 1320 | Contig 82 |

TABLE 4

Clone names for NSCLC-SCL3-SCL4 and corresponding SEQ ID NOs

| SEQ ID NO | CLONE IDENTIFIER |
|---|---|
| 1321 | Contig 94 |
| 1322 | Contig 95 |
| 1323 | Contig 96 |
| 1324 | Contig 97 |
| 1325 | Contig 98 |
| 1326 | Contig 99 |
| 1327 | Contig 100 |
| 1328 | Contig 101 |
| 1329 | Contig 102 |
| 1330 | Contig 103 |
| 1331 | Contig 104 |
| 1332 | Contig 105 |
| 1333 | Contig 106 |
| 1334 | Contig 107 |
| 1335 | Contig 108 |
| 1336 | Contig 109 |
| 1337 | Contig 110 |
| 1338 | Contig 111 |
| 1339 | Contig 112 |
| 1340 | Contig 113 |
| 1341 | Contig 114 |
| 1342 | Contig 115 |
| 1343 | Contig 116 |
| 1344 | Contig 117 |
| 1345 | Contig 118 |
| 1346 | Contig 119 |
| 1347 | Contig 120 |
| 1348 | Contig 121 |
| 1349 | Contig 122 |
| 1350 | Contig 123 |
| 1351 | Contig 124 |
| 1352 | Contig 125 |
| 1353 | Contig 126 |
| 1354 | Contig 127 |
| 1355 | Contig 128 |
| 1356 | Contig 129 |
| 1357 | Contig 130 |
| 1358 | Contig 131 |
| 1359 | Contig 132 |
| 1360 | Contig 133 |
| 1361 | Contig 134 |

TABLE 4-continued

Clone names for NSCLC-SCL3-SCL4 and corresponding SEQ ID NOs

| SEQ ID NO | CLONE IDENTIFIER |
|---|---|
| 1362 | Contig 135 |
| 1363 | Contig 136 |
| 1364 | Contig 137 |
| 1365 | Contig 138 |
| 1366 | Contig 139 |
| 1367 | Contig 140 |
| 1368 | Contig 141 |
| 1369 | Contig 142 |
| 1370 | Contig 143 |
| 1371 | Contig 144 |
| 1372 | Contig 145 |
| 1373 | Contig 146 |
| 1374 | Contig 147 |
| 1375 | Contig 148 |
| 1376 | Contig 149 |
| 1377 | Contig 150 |
| 1378 | Contig 151 |
| 1379 | Contig 152 |
| 1380 | Contig 153 |
| 1381 | Contig 154 |
| 1382 | Contig 155 |
| 1383 | Contig 156 |
| 1384 | Contig 157 |
| 1385 | Contig 158 |
| 1386 | Contig 159 |
| 1387 | Contig 160 |
| 1388 | Contig 161 |
| 1389 | Contig 162 |
| 1390 | Contig 163 |
| 1391 | Contig 164 |
| 1392 | Contig 165 |
| 1393 | Contig 166 |
| 1394 | Contig 167 |
| 1395 | Contig 168 |
| 1396 | Contig 169 |
| 1397 | Contig 170 |
| 1398 | Contig 171 |
| 1399 | Contig 172 |
| 1400 | Contig 173 |
| 1401 | Contig 174 |
| 1402 | Contig 175 |
| 1403 | Contig 176 |
| 1404 | Contig 177 |
| 1405 | Contig 178 |
| 1406 | Contig 179 |
| 1407 | Contig 180 |
| 1408 | Contig 181 |
| 1409 | Contig 182 |
| 1410 | Contig 183 |
| 1411 | Contig 184 |
| 1412 | Contig 185 |
| 1413 | Contig 186 |
| 1414 | Contig 187 |

TABLE 5

Clone names for SCLC-SQL1 and corresponding SEQ ID NOs

| SEQ ID NO | CLONE IDENTIFIER |
|---|---|
| 1415 | Contig 17 |
| 1416 | Contig 18 |
| 1417 | Contig 20 |
| 1418 | Contig 23 |
| 1419 | Contig 24 |
| 1420 | Contig 25 |
| 1421 | Contig 26 |
| 1422 | Contig 27 |

TABLE 5-continued

Clone names for SCLC-SQL1 and corresponding SEQ ID NOs

| SEQ ID NO | CLONE IDENTIFIER |
|---|---|
| 1423 | Contig 28 |
| 1424 | Contig 29 |
| 1425 | Contig 30 |
| 1426 | Contig 31 |
| 1427 | Contig 20 |
| 1428 | Contig 21 |
| 1429 | Contig 22 |
| 1430 | Contig 23 |
| 1431 | Contig 24 |
| 1432 | Contig 25 |
| 1433 | Contig 26 |
| 1434 | Contig 27 |
| 1435 | Contig 28 |
| 1436 | Contig 29 |
| 1437 | Contig 30 |
| 1438 | Contig 31 |
| 1439 | Contig 32 |
| 1440 | Contig 33 |
| 1441 | Contig 34 |
| 1442 | Contig 35 |
| 1443 | Contig 36 |
| 1444 | Contig 37 |
| 1445 | Contig 38 |

TABLE 6

Clone names for SCLC-SCL3-SCL4 and corresponding SEQ ID NOs

| SEQ ID NO | CLONE IDENTIFIER |
|---|---|
| 1446 | Contig 116 |
| 1447 | Contig 117 |
| 1448 | Contig 118 |
| 1449 | Contig 119 |
| 1450 | Contig 120 |
| 1451 | Contig 122 |
| 1452 | Contig 123 |
| 1453 | Contig 124 |
| 1454 | Contig 125 |
| 1455 | Contig 126 |
| 1456 | Contig 127 |
| 1457 | Contig 128 |
| 1458 | Contig 129 |
| 1459 | Contig 130 |
| 1460 | Contig 131 |
| 1461 | Contig 132 |
| 1462 | Contig 133 |
| 1463 | Contig 135 |
| 1464 | Contig 136 |
| 1465 | Contig 137 |
| 1466 | Contig 138 |
| 1467 | Contig 139 (L985P) |
| 1468 | Contig 140 |
| 1469 | Contig 141 |
| 1470 | Contig 142 |
| 1471 | Contig 143 |
| 1472 | Contig 144 |
| 1473 | Contig 145 |
| 1474 | Contig 146 |
| 1475 | Contig 147 |
| 1476 | Contig 148 |
| 1477 | Contig 149 |
| 1478 | Contig 150 |
| 1479 | Contig 151 |
| 1480 | Contig 152 |
| 1481 | Contig 153 |
| 1482 | Contig 154 |
| 1483 | Contig 155 |

TABLE 6-continued

Clone names for SCLC-SCL3-SCL4 and corresponding SEQ ID NOs

| SEQ ID NO | CLONE IDENTIFIER |
|---|---|
| 1484 | Contig 156 |
| 1485 | Contig 157 |
| 1486 | Contig 158 |
| 1487 | Contig 159 |
| 1488 | Contig 160 |
| 1489 | Contig 161 |
| 1490 | Contig 162 |
| 1491 | Contig 163 |
| 1492 | Contig 164 |
| 1493 | Contig 165 |
| 1494 | Contig 166 |
| 1495 | Contig 167 |
| 1496 | Contig 168 |
| 1497 | Contig 169 |
| 1498 | Contig 170 |
| 1499 | Contig 171 |
| 1500 | Contig 172 |
| 1501 | Contig 173 |
| 1502 | Contig 174 |
| 1503 | Contig 175 |
| 1504 | Contig 176 |
| 1505 | Contig 177 |
| 1506 | Contig 178 |
| 1507 | Contig 179 |
| 1508 | Contig 181 |
| 1509 | Contig 182 |
| 1510 | Contig 183 |
| 1511 | Contig 184 |
| 1512 | Contig 185 |
| 1513 | Contig 186 |
| 1514 | Contig 187 |
| 1515 | Contig 189 |
| 1516 | Contig 190 |
| 1517 | Contig 191 |
| 1518 | Contig 192 |
| 1519 | Contig 193 |
| 1520 | Contig 194 |
| 1521 | Contig 195 |
| 1522 | Contig 196 |
| 1523 | Contig 197 |
| 1524 | Contig 198 |
| 1525 | Contig 199 |
| 1526 | Contig 200 |
| 1527 | Contig 201 |
| 1528 | Contig 202 |
| 1529 | Contig 203 |
| 1530 | Contig 204 |
| 1531 | Contig 205 |
| 1532 | Contig 206 |
| 1533 | Contig 207 |
| 1534 | Contig 208 |
| 1535 | Contig 209 |
| 1536 | Contig 210 |
| 1537 | Contig 211 |
| 1538 | Contig 212 |
| 1539 | Contig 213 |
| 1540 | Contig 214 |
| 1541 | Contig 215 |
| 1542 | Contig 216 |
| 1543 | Contig 217 |
| 1544 | Contig 218 |
| 1545 | Contig 219 |
| 1546 | Contig 220 |
| 1547 | Contig 221 |
| 1548 | Contig 222 |
| 1549 | Contig 223 |
| 1550 | Contig 224 |
| 1551 | Contig 225 |
| 1552 | Contig 226 |
| 1553 | Contig 227 |
| 1554 | Contig 228 |
| 1555 | Contig 229 |
| 1556 | Contig 230 |

TABLE 6-continued

Clone names for SCLC-SCL3-SCL4 and corresponding SEQ ID NOs

| SEQ ID NO | CLONE IDENTIFIER |
|---|---|
| 1557 | Contig 231 |
| 1558 | Contig 232 |
| 1559 | Contig 233 |
| 1560 | Contig 234 |
| 1561 | Contig 235 |
| 1562 | Contig 236 |
| 1563 | Contig 237 |

TABLE 7

| SEQ ID NO: | CLONE IDENTIFIER |
|---|---|
| 1564 | R0124:E05 |
| 1565 | R0124:E06 |
| 1566 | R0124:E08 |
| 1567 | R0124:F07 |
| 1568 | R0124:F08 |
| 1569 | R0124:F09 |
| 1570 | R0124:G04 |
| 1571 | R0129:A02 |
| 1572 | R0129:A03 |
| 1573 | R0129:A06 |
| 1574 | R0129:A07 |
| 1575 | R0129:A08 |
| 1576 | R0129:A09 |
| 1577 | R0129:A10 |
| 1578 | R0129:A11 |
| 1579 | R0129:A12 |
| 1580 | R0129:B02 |
| 1581 | R0129:B03 |
| 1582 | R0129:B04 |
| 1583 | R0129:B05 |
| 1584 | R0129:B06 |
| 1585 | R0129:B07 |
| 1586 | R0129:B08 |
| 1587 | R0129:B09 |
| 1588 | R0129:B10 |
| 1589 | R0129:B11 |
| 1590 | R0129:B12 |
| 1591 | R0129:C01 |
| 1592 | R0129:C02 |
| 1593 | R0129:C03 |
| 1594 | R0129:C04 |
| 1595 | R0129:C06 |
| 1596 | R0129:C07 |
| 1597 | R0129:C08 |
| 1598 | R0129:C09 |
| 1599 | R0129:C10 |
| 1600 | R0129:C11 |
| 1601 | R0129:C12 |
| 1602 | R0129:D01 |
| 1603 | R0129:D03 |
| 1604 | R0129:D04 |
| 1605 | R0129:D05 |
| 1606 | R0129:D06 |
| 1607 | R0129:D07 |
| 1608 | R0129:D08 |
| 1609 | R0129:D09 |
| 1610 | R0129:D10 |
| 1611 | R0129:D11 |
| 1612 | R0129:E02 |
| 1613 | R0129:E03 |
| 1614 | R0129:E04 |
| 1615 | R0129:E05 |
| 1616 | R0129:E06 |
| 1617 | R0129:E07 |
| 1618 | R0129:E08 |
| 1619 | R0129:E09 |
| 1620 | R0129:E11 |

TABLE 7-continued

| SEQ ID NO: | CLONE IDENTIFIER |
|---|---|
| 1621 | R0129:E12 |
| 1622 | R0129:F01 |
| 1623 | R0129:F02 |
| 1624 | R0129:F03 |
| 1625 | R0129:F04 |
| 1626 | R0129:F06 |
| 1627 | R0129:F07 |
| 1628 | R0129:F08 |
| 1629 | R0129:F09 |
| 1630 | R0129:F10 |
| 1631 | R0129:F11 |
| 1632 | R0129:F12 |
| 1633 | R0129:G01 |
| 1634 | R0129:G02 |
| 1635 | R0129:G03 |
| 1636 | R0129:G04 |
| 1637 | R0129:G05 |
| 1638 | R0129:G06 |
| 1639 | R0129:G07 |
| 1640 | R0129:G08 |
| 1641 | R0129:G09 |
| 1642 | R0129:G10 |
| 1643 | R0129:G11 |
| 1644 | R0129:G12 |
| 1645 | R0129:H01 |
| 1646 | R0129:H02 |
| 1647 | R0129:H03 |
| 1648 | R0129:H04 |
| 1649 | R0129:H05 |
| 1650 | R0129:H08 |
| 1651 | R0129:H09 |
| 1652 | R0129:H10 |
| 1653 | R0129:H11 |

TABLE 8

| SEQ ID NO: | CLONE IDENTIFIER |
|---|---|
| 1654 | 26484 |
| 1655 | 26496 |
| 1656 | 26517 |
| 1657 | 26531 |
| 1658 | 26022 |
| 1659 | 26026 |
| 1660 | 26810 |
| 1661 | 26815 |
| 1662 | 26869 |
| 1663 | 26883 |
| 1664 | 26902 |

SEQ ID NO:1665 and 1666 are primers used in the amplification of the coding region of L548S SEQ ID NO:1667 is the protein sequence of expressed recombinant L7548S.

SEQ ID NO:1668 is the cDNA sequence of expressed recombinant L7548S.

SEQ ID NO:1669 is the extended cDNA sequence of clone #18971 (L801P).

SEQ ID NO:1670 is the amino acid sequence of open reading frame ORF4 encoded by SEQ ID NO:1669.

SEQ ID NO:1671 is the amino acid sequence of open reading frame ORF5 encoded by SEQ ID NO:1669.

SEQ ID NO:1672 is the amino acid sequence of open reading frame ORF6 encoded by SEQ ID NO:1669.

SEQ ID NO:1673 is the amino acid sequence of open reading frame ORF7 encoded by SEQ ID NO:1669.

SEQ ID NO:1674 is the amino acid sequence of open reading frame ORF8 encoded by SEQ ID NO:1669.

SEQ ID NO:1675 is the amino acid sequence of open reading frame ORF9 encoded by SEQ ID NO:1669.

SEQ ID NO:1676 is the extended cDNA for contig 139 (SEQ ID NO:1467), also known as L985P.

SEQ ID NO:1677 is the L985P amino acid sequence encoded by SEQ ID NO:1676.

SEQ ID NO:1678 is the amino acid sequence of open reading frame ORF5× of SEQ ID NO:1669.

SEQ ID NO:1679 is the amino acid sequence of an open reading frame for contig 139 (SEQ ID NO:1467).

SEQ ID NO:1680-1788, set forth in the Table 9, represent cDNA clones identified by microarray analysis of the SQL1, SCL1, SCL3 and SCL4 libraries on lung chip 5.

TABLE 9

| SEQ ID NO: | CLONE IDENTIFIER |
|---|---|
| 1680 | 58456 |
| 1681 | 58458 |
| 1682 | 58462 |
| 1683 | 58469 |
| 1684 | 58470 |
| 1685 | 58482 |
| 1686 | 58485 |
| 1687 | 58501 |
| 1688 | 58502 |
| 1689 | 58505 |
| 1690 | 58507 |
| 1691 | 58509 |
| 1692 | 58512 |
| 1693 | 58527 |
| 1694 | 58529 |
| 1695 | 58531 |
| 1696 | 58537 |
| 1697 | 58539 |
| 1698 | 58545 |
| 1699 | 59319 |
| 1700 | 59322 |
| 1701 | 59348 |
| 1702 | 59350 |
| 1703 | 59363 |
| 1704 | 59365 |
| 1705 | 59370 |
| 1706 | 59373 |
| 1707 | 59376 |
| 1708 | 61050 |
| 1709 | 61051 |
| 1710 | 61052 |
| 1711 | 61054 |
| 1712 | 61056 |
| 1713 | 61057 |
| 1714 | 61060 |
| 1715 | 61062 |
| 1716 | 61063 |
| 1717 | 61064 |
| 1718 | 61065 |
| 1719 | 61066 |
| 1720 | 61069 |
| 1721 | 61070 |
| 1722 | 61071 |
| 1723 | 61074 |
| 1724 | 61075 |
| 1725 | 61077 |
| 1726 | 61079 |
| 1727 | 61080 |
| 1728 | 61081 |
| 1729 | 61083 |
| 1730 | 61085 |
| 1731 | 61086 |
| 1732 | 61088 |
| 1733 | 61090 |
| 1734 | 61091 |
| 1735 | 61093 |
| 1736 | 61094 |
| 1737 | 61096 |
| 1738 | 61097 |

TABLE 9-continued

| SEQ ID NO: | CLONE IDENTIFIER |
|---|---|
| 1739 | 61099 |
| 1740 | 61100 |
| 1741 | 61103 |
| 1742 | 61105 |
| 1743 | 61106 |
| 1744 | 61110 |
| 1745 | 61113 |
| 1746 | 61115 |
| 1747 | 61117 |
| 1748 | 61118 |
| 1749 | 61119 |
| 1750 | 61120 |
| 1751 | 61122 |
| 1752 | 61125 |
| 1753 | 61126 |
| 1754 | 61130 |
| 1755 | 61133 |
| 1756 | 61134 |
| 1757 | 61135 |
| 1758 | 61137 |
| 1759 | 61139 |
| 1760 | 61143 |
| 1761 | 61144 |
| 1762 | 61148 |
| 1763 | 61151 |
| 1764 | 61155 |
| 1765 | 61156 |
| 1766 | 61159 |
| 1767 | 61160 |
| 1768 | 61163 |
| 1769 | 61167 |
| 1770 | 61172 |
| 1771 | 61173 |
| 1772 | 61176 |
| 1773 | 61177 |
| 1774 | 61183 |
| 1775 | 61185 |
| 1776 | 61188 |
| 1777 | 61192 |
| 1778 | 61198 |
| 1779 | 61201 |
| 1780 | 61202 |
| 1781 | 61204 |
| 1782 | 61206 |
| 1783 | 61210 |
| 1784 | 61212 |
| 1785 | 61216 |
| 1786 | 61225 |
| 1787 | 61226 |
| 1788 | 61227 |

SEQ ID NO:1789 is the cDNA sequence of clone #47988 (L972P).

SEQ ID NO:1790 is the cDNA sequence of clone #48005 (L979P).

SEQ ID NO:1791 is an extended cDNA sequence for clone #48005 (L979P).

SEQ ID NO:1792 is an extended cDNA sequence for clone #49826 (SEQ ID NO:1279; L980P).

SEQ ID NO:1793 is an extended cDNA sequence for clone #20631 (SEQ ID NO:117; L973P).

SEQ ID NO:1794 is an extended cDNA sequence for clone #20661 (SEQ ID NO:128; L974P).

SEQ ID NO:1795 is an extended cDNA sequence for clone #50430 (SEQ ID NO:1442; L996P).

SEQ ID NO:1796 is an extended cDNA sequence for clone #26961 (SEQ ID NO:288; L977P).

SEQ ID NO:1797 is an extended cDNA sequence for clone #24928 (SEQ ID NO:1339; L978P).

SEQ ID NO:1798 is an extended cDNA sequence for clone #50507 (SEQ ID NO:1446; L984P).

SEQ ID NO:1799 is an extended cDNA sequence for clone #50645 (SEQ ID NO:1531; L988P).

SEQ ID NO:1800 is an extended cDNA sequence for clone #50628 (SEQ ID NO:1533; L1423P).

SEQ ID NO:1801 is an extended cDNA sequence for clone #50560 (SEQ ID NO:1527; L987P).

SEQ ID NO:1802 is an extended cDNA sequence for clone #27699 (SEQ ID NO:468; L998P).

SEQ ID NO:1803 is an extended cDNA sequence for clone #59303 (SEQ ID NO:949; L1425P).

SEQ ID NO:1804 is an extended cDNA sequence for clone #59314 (SEQ ID NO:1156; L1426P).

SEQ ID NO:1805 is an extended cDNA sequence for clone #59298 (SEQ ID NO:921; L1427P).

SEQ ID NO:1806 is an amino acid sequence encoded by SEQ ID NO:1791.

SEQ ID NO:1807 is an amino acid sequence encoded by SEQ ID NO:1792.

SEQ ID NO:1808 is an amino acid sequence encoded by SEQ ID NO:1793.

SEQ ID NO:1809 is an amino acid sequence encoded by SEQ ID NO:1794.

SEQ ID NO:1810 is an amino acid sequence encoded by SEQ ID NO:1795.

SEQ ID NO:1811 is an amino acid sequence encoded by SEQ ID NO:1796.

SEQ ID NO:1812 is an amino acid sequence encoded by SEQ ID NO:1797.

SEQ ID NO:1813 is an amino acid sequence encoded by SEQ ID NO:1798.

SEQ ID NO:1814 is an amino acid sequence encoded by SEQ ID NO:1799.

SEQ ID NO:1815 is an amino acid sequence encoded by SEQ ID NO:1800.

SEQ ID NO:1816 is an amino acid sequence encoded by SEQ ID NO:1527 (L987P).

SEQ ID NO:1817 is an amino acid sequence encoded by SEQ ID NO:1823.

SEQ ID NO:1818 is an amino acid sequence encoded by SEQ ID NO:1801.

SEQ ID NO:1819 is an amino acid sequence encoded by SEQ ID NO:1802.

SEQ ID NO:1820 is an amino acid sequence encoded by SEQ ID NO:1803.

SEQ ID NO:1821 is an amino acid sequence encoded by SEQ ID NO:1804.

SEQ ID NO:1822 is an amino acid sequence encoded by SEQ ID NO:1805.

SEQ ID NO:1823 is an extended cDNA sequence for clone #50560 (SEQ ID NO:1527; L987P).

SEQ ID NO:1824 is a full length cDNA sequence for clone L872P (SEQ ID NO:34).

SEQ ID NO:1825 is the amino acid sequence encoded by SEQ ID NO:1824.

SEQ ID NO:1826 is the cDNA sequence encoding the N-terminal portion of L552S.

SEQ ID NO:1827-1829 are cDNA sequences of portions of L552S.

SEQ ID NO:1830 is the N-terminal portion of L552S.

SEQ ID NO:1831-1833 are the amino acid sequences encoded by SEQ ID NO:1827-1829, respectively.

SEQ ID NO:1834-1856 are the amino acid sequences of peptides of L548S.

SEQ ID NO:1857-1860 are PCR primers.

SEQ ID NO:1861 is the determined DNA sequence for a fusion of Ra12 and ORF4 of P801P.

SEQ ID NO:1862 is the determined DNA sequence for a fusion of Ra12 and ORF5 of P801P.

SEQ ID NO:1863 is the amino acid sequence of the fusion of Ra12 and ORF4 of P801P.

SEQ ID NO:1864 is the amino acid sequence of the fusion of Ra12 and ORF5 of P801P.

SEQ ID NO:1865 is the determined cDNA sequence for clone L984P_(573A).

SEQ ID NO:1866 is the determined cDNA sequence for clone L984P_(512A).

SEQ ID NO:1867 is the determined cDNA sequence for clone L984P_(NCI-H128).

SEQ ID NO:1868 is the determined cDNA sequence for clone L984P_(DMS-79).

SEQ ID NO:1869 is the amino acid sequence encoded by SEQ ID NO:1865.

SEQ ID NO:1870 is the amino acid sequence encoded by SEQ ID NO:1866.

SEQ ID NO:1871 is the amino acid sequence encoded by SEQ ID NO:1867.

SEQ ID NO:1872 is the amino acid sequence encoded by SEQ ID NO:1868.

SEQ ID NO:1873 is a full length cDNA sequence for clone L985P (partial sequence given in SEQ ID NO:1467).

SEQ ID NO:1874 is the amino acid sequence for L985P encoded by SEQ ID NO:1873.

SEQ ID NO:1875 is the predicted and determined cDNA sequence for a fusion of Ra12 and L985P.

SEQ ID NO:1876 is the predicted amino acid sequence of a fusion of Ra12 and L985P encoded by SEQ ID NO:1875.

SEQ ID NO:1877 is the predicted cDNA sequence for a fusion of Ra12S and L985P.

SEQ ID NO:1878 is the predicted amino acid sequence of a fusion of Ra12S and L985P encoded by SEQ ID NO:1877.

SEQ ID NO:1879 is the predicted cDNA sequence for a fusion of Ra12S and L985PEx.

SEQ ID NO:1880 is the predicted amino acid sequence of a fusion of Ra12S and L985PEx encoded by SEQ ID NO:1879.

SEQ ID NO:1881 is the predicted cDNA sequence the extracellular loop 2 peptide of L985P.

SEQ ID NO:1882 is the predicted amino acid sequence for the extracellular loop 2 peptide of L985P encoded by SEQ ID NO:1875.

SEQ ID NO:1883 is an extended cDNA sequence for clone #59316 (SEQ ID NO:1180; L1428P).

SEQ ID NO:1884 is a first predicted amino acid sequence encoded by SEQ ID NO:1883 and designated L1428P—ORF1.

SEQ ID NO:1885 is a second predicted amino acid sequence encoded by SEQ ID NO:1883 and designated L1428P—ORF2.

SEQ ID NO:1886 is a third predicted amino acid sequence encoded by SEQ ID NO:1883 and designated L1428P—ORF3.

SEQ ID NO:1887 is a fourth predicted amino acid sequence encoded by SEQ ID NO:1883 and designated L1428P—ORF4.

SEQ ID NO:1888 is a fifth predicted amino acid sequence encoded by SEQ ID NO:1883 and designated L1428P—ORF5.

SEQ ID NO:1889 is a sixth predicted amino acid sequence encoded by SEQ ID NO:1883 and designated L1428P—ORF6.

SEQ ID NO:1890 is a seventh predicted amino acid sequence encoded by SEQ ID NO:1883 and designated L1428P—ORF7.

SEQ ID NO:1891-1900 are the nucleotide sequences for the database hits described in Table 17.

SEQ ID NO:1901-1909 are the deduced amino acid sequences encoded by the nucleotide sequences described in Table 17.

SEQ ID NO:1910 is the full-length cDNA for clone L1437P (partial sequence given in SEQ ID NO:1896).

SEQ ID NO:1911 is the forward primer PDM-433 for the coding region of clone L548S.

SEQ ID NO:1912 is the reverse primer PDM-438 for the coding region of clone L548S.

SEQ ID NO:1913 is the amino acid sequence for the expressed recombinant L548S.

SEQ ID NO:1914 is the DNA coding sequence for the recombinant L548S.

SEQ ID NO:1915 is the forward primer PDM-498 for the coding region of clone L551 S SEQ ID NO:1916 is the reverse primer PDM-499 for the coding region of clone L551 S SEQ ID NO:1917 is the amino acid sequence for the expressed recombinant L551S.

SEQ ID NO:1918 is the DNA coding sequence for the recombinant L551 S.

SEQ ID NO:1919 is the forward primer PDM-479 for the coding region of clone L552S SEQ ID NO:1920 is the reverse primer PDM-480 for the coding region of clone L552S SEQ ID NO:1921 is the amino acid sequence for the expressed recombinant L552S.

SEQ ID NO:1922 is the DNA coding sequence for the recombinant L552S.

SEQ ID NO:1923 is the predicted full-length cDNA sequence for clone #19069 (partial sequence given in SEQ ID NO:90).

SEQ ID NO:1924 is the predicted full-length cDNA sequence for clone #18965 or #19002 (partial sequence given in SEQ ID NO:15).

SEQ ID NO:1925 is the deduced amino acid sequence encoded by SEQ ID NO:1923.

SEQ ID NO:1926 is the deduced amino acid sequence encoded by SEQ ID NO:1924.

SEQ ID NO:1927 is the determined amino acid sequence of a first L552S epitope.

SEQ ID NO:1928 is the determined amino acid sequence of a second L552S epitope.

SEQ ID NO:1929 is the determined amino acid sequence of a third L552S epitope.

SEQ ID NO:1930 is the amino acid sequence for L985P peptide #3482.

SEQ ID NO:1931 is an extended cDNA sequence for clone #61144 (SEQ ID NO:1761, L1439P).

SEQ ID NO:1932 is the deduced amino acid sequence encoded by SEQ ID NO:1931.

SEQ ID NO:1933 is the full-length cDNA of the NUF2R gene to which SEQ ID NO:1931 shows some sequence similarity.

SEQ ID NO:1934 is the deduced amino acid sequence encoded by SEQ ID NO:1933.

SEQ ID NO:1935 is a forward primer PDM-737 for the coding region of clone L552S.

SEQ ID NO:1936 is a reverse primer PDM-738 for the coding region of clone L552S.

SEQ ID NO:1937 is the amino acid sequence for expressed recombinant L552S.

SEQ ID NO:1938 is the DNA coding sequence for the recombinant L552S.

SEQ ID NO:1939 is another forward primer PDM-736 for the coding region of clone L552S.

SEQ ID NO:1940 is the amino acid sequence for a second expressed recombinant L552S.

SEQ ID NO:1941 is the DNA coding sequence for a second recombinant L552S.

SEQ ID NO:1942 is the determined amino acid sequence of a fourth L552S epitope.

SEQ ID NO:1943 is the determined amino acid sequence of a first XAGE-1 epitope.

SEQ ID NO:1944 is the determined amino acid sequence of a second XAGE-1 epitope.

SEQ ID NO:1945 is the determined amino acid sequence of a first 20-mer peptide corresponding to amino acid residues 1-20 of full-length L552S (SEQ ID NO:809).

SEQ ID NO:1946 is the determined amino acid sequence of a second 20-mer peptide corresponding to amino acid residues 6-25 of full-length L552S (SEQ ID NO:809).

SEQ ID NO:1947 is the determined amino acid sequence of a third 20-mer peptide corresponding to amino acid residues 11-30 of full-length L552S (SEQ ID NO:809).

SEQ ID NO:1948 is the determined amino acid sequence of a fourth 20-mer peptide corresponding to amino acid residues 16-35 of full-length L552S (SEQ ID NO:809).

SEQ ID NO:1949 is the determined amino acid sequence of a fifth 20-mer peptide corresponding to amino acid residues 21-40 of full-length L552S (SEQ ID NO:809).

SEQ ID NO:1950 is the determined amino acid sequence of a sixth 20-mer peptide corresponding to amino acid residues 26-45 of full-length L552S (SEQ ID NO:809).

SEQ ID NO:1951 is the determined amino acid sequence of a seventh 20-mer peptide corresponding to amino acid residues 31-50 of full-length L552S (SEQ ID NO:809).

SEQ ID NO:1952 is the determined amino acid sequence of a eigth 20-mer peptide corresponding to amino acid residues 36-55 of full-length L552S (SEQ ID NO:809).

SEQ ID NO:1953 is the determined amino acid sequence of a ninth 20-mer peptide corresponding to amino acid residues 41-60 of full-length L552S (SEQ ID NO:809).

SEQ ID NO:1954 is the determined amino acid sequence of a tenth 20-mer peptide corresponding to amino acid residues 46-65 of full-length L552S (SEQ ID NO:809).

SEQ ID NO:1955 is the determined amino acid sequence of a eleventh 20-mer peptide corresponding to amino acid residues 51-70 of full-length L552S (SEQ ID NO:809).

SEQ ID NO:1955 is the determined amino acid sequence of a twelveth 20-mer peptide corresponding to amino acid residues 56-75 of full-length L552S (SEQ ID NO:809).

SEQ ID NO:1956 is the determined amino acid sequence of a thirth 20-mer peptide corresponding to amino acid residues 61-80 of full-length L552S (SEQ ID NO:809).

SEQ ID NO:1957 is the determined amino acid sequence of a fourteenth 20-mer peptide corresponding to amino acid residues 66-85 of full-length L552S (SEQ ID NO:809).

SEQ ID NO:1958 is the determined amino acid sequence of a fifteenth 20-mer peptide corresponding to amino acid residues 71-90 of full-length L552S (SEQ ID NO:809).

SEQ ID NO:1959 is the determined amino acid sequence of a sixteenth 20-mer peptide corresponding to amino acid residues 76-95 of full-length L552S (SEQ ID NO:809).

SEQ ID NO:1961 is the determined amino acid sequence of a seventeen 20-mer peptide corresponding to amino acid residues 81-100 of full-length L552S (SEQ ID NO:809).

SEQ ID NO:1962 is the determined amino acid sequence of a eighthth 20-mer peptide corresponding to amino acid residues 86-105 of full-length L552S (SEQ ID NO:809).

SEQ ID NO:1963 is the determined amino acid sequence of a nineteenth 20-mer peptide corresponding to amino acid residues 91-110 of full-length L552S (SEQ ID NO:809).

SEQ ID NO:1964 is the determined amino acid sequence of a twentieth 20-mer peptide corresponding to amino acid residues 96-115 of full-length L552S (SEQ ID NO:809).

SEQ ID NO:1965 is the determined amino acid sequence of a twenty-first 20-mer peptide corresponding to amino acid residues 101-120 of full-length L552S (SEQ ID NO:809).

SEQ ID NO:1966 is the determined amino acid sequence of a twenty-second 20-mer peptide corresponding to amino acid residues 106-125 of full-length L552S (SEQ ID NO:809).

SEQ ID NO:1967 is the determined amino acid sequence of a twenty-third 20-mer peptide corresponding to amino acid residues 111-130 of full-length L552S (SEQ ID NO:809).

SEQ ID NO:1968 is the determined amino acid sequence of a twenty-fourth 20-mer peptide corresponding to amino acid residues 116-135 of full-length L552S (SEQ ID NO:809).

SEQ ID NO:1969 is the determined amino acid sequence of a twenty-fifth 20-mer peptide corresponding to amino acid residues 121-140 of full-length L552S (SEQ ID NO:809).

SEQ ID NO:1970 is the determined amino acid sequence of a twenty-sixth 20-mer peptide corresponding to amino acid residues 126-145 of full-length L552S (SEQ ID NO:809).

SEQ ID NO:1971 is the determined amino acid sequence of a twenth-seventh 20-mer peptide corresponding to amino acid residues 131-150 of full-length L552S (SEQ ID NO:809).

SEQ ID NO:1972 is the determined amino acid sequence of a twenty-eigth 20-mer peptide corresponding to amino acid residues 136-155 of full-length L552S (SEQ ID NO:809).

SEQ ID NO:1973 is the determined amino acid sequence of a twenty-ninth 20-mer peptide corresponding to amino acid residues 141-160 of full-length L552S (SEQ ID NO:809).

SEQ ID NO:1974 is the DNA sequence which encodes the 20-mer of SEQ ID NO:1945.

SEQ ID NO:1975 is the DNA sequence which encodes the 20-mer of SEQ ID NO:1946.

SEQ ID NO:1976 is the DNA sequence which encodes the 20-mer of SEQ ID NO:1947.

SEQ ID NO:1977 is the DNA sequence which encodes the 20-mer of SEQ ID NO:1948.

SEQ ID NO:1978 is the DNA sequence which encodes the 20-mer of SEQ ID NO:1949.

SEQ ID NO:1979 is the DNA sequence which encodes the 20-mer of SEQ ID NO:1950.

SEQ ID NO:1980 is the DNA sequence which encodes the 20-mer of SEQ ID NO:1951.

SEQ ID NO:1981 is the DNA sequence which encodes the 20-mer of SEQ ID NO:1952.

SEQ ID NO:1982 is the DNA sequence which encodes the 20-mer of SEQ ID NO:1953.

SEQ ID NO:1983 is the DNA sequence which encodes the 20-mer of SEQ ID NO:1954.

SEQ ID NO:1984 is the DNA sequence which encodes the 20-mer of SEQ ID NO:1955.

SEQ ID NO:1985 is the DNA sequence which encodes the 20-mer of SEQ ID NO:1956.

SEQ ID NO:1986 is the DNA sequence which encodes the 20-mer of SEQ ID NO:1957.

SEQ ID NO:1987 is the DNA sequence which encodes the 20-mer of SEQ ID NO:1958.

SEQ ID NO:1988 is the DNA sequence which encodes the 20-mer of SEQ ID NO:1959.

SEQ ID NO:1989 is the DNA sequence which encodes the 20-mer of SEQ ID NO:1960.

SEQ ID NO:1990 is the DNA sequence which encodes the 20-mer of SEQ ID NO:1961.

SEQ ID NO:1991 is the DNA sequence which encodes the 20-mer of SEQ ID NO:1962.

SEQ ID NO:1992 is the DNA sequence which encodes the 20-mer of SEQ ID NO:1963.

SEQ ID NO:1993 is the DNA sequence which encodes the 20-mer of SEQ ID NO:1964.

SEQ ID NO:1994 is the DNA sequence which encodes the 20-mer of SEQ ID NO:1965.

SEQ ID NO:1995 is the DNA sequence which encodes the 20-mer of SEQ ID NO:1966.

SEQ ID NO:1996 is the DNA sequence which encodes the 20-mer of SEQ ID NO:1967.

SEQ ID NO:1997 is the DNA sequence which encodes the 20-mer of SEQ ID NO:1968.

SEQ ID NO:1998 is the DNA sequence which encodes the 20-mer of SEQ ID NO:1969.

SEQ ID NO:1999 is the DNA sequence which encodes the 20-mer of SEQ ID NO:1970.

SEQ ID NO:2000 is the DNA sequence which encodes the 20-mer of SEQ ID NO:1971.

SEQ ID NO:2001 is the DNA sequence which encodes the 20-mer of SEQ ID NO:1972.

SEQ ID NO:2002 is the DNA sequence which encodes the 20-mer of SEQ ID NO:1973.

SEQ ID NO:2003 is the DNA sequence which encodes the full-length L985P Gly 119.

SEQ ID NO:2004 is the predicted protein sequence of full-length L985P Gly 119, encoded by SEQ ID NO:2003.

SEQ ID NO:2005 is the amino acid sequence of the 20-mer peptide #20 of full-length L552S (SEQ ID NO:809).

SEQ ID NO:2006 is the amino acid sequence of the overlapping peptides #4-#6 of full-length L552S (SEQ ID NO:809).

SEQ ID NO:2007 is the amino acid sequence of the overlapping peptides #16-#18 of full-length L552S (SEQ ID NO:809).

SEQ ID NO:2008 is the amino acid sequence of the overlapping peptides #22-#24 of full-length L552S (SEQ ID NO:809).

SEQ ID NO:2009 is the amino acid sequence of the overlapping peptides #25-#27 of full-length L552S (SEQ ID NO:809).

SEQ ID NO:2010 is the amino acid sequence of the peptide epitope of L984P recognized by donor D223 (overlapping peptide #17 of L984P).

SEQ ID NO:2011 is the amino acid sequence of the peptide epitope of L984P recognized by donor D336 (overlapping peptide #3 of L984P).

SEQ ID NOs:2012-2103 are the amino acid sequences of a series of L978P 20-mer peptides overlapping by 15 amino acids, corresponding to peptides 1-92.

SEQ ID NO:2104 is the amino acid sequence of a L978P minimal epitope recognized by T cell line 1AH8, corresponding to residues 66-80.

SEQ ID NO:2105 is the DNA sequence corresponding to SEQ ID NO:2104.

SEQ ID NO:2106 is the amino acid sequence of a L978P minimal epitope recognized by T cell line 1AH8, corresponding to residues 106-115.

SEQ ID NO:2107 is the DNA sequence corresponding to SEQ ID NO:2106.

SEQ ID NO:2108 is the amino acid sequence of a L978P minimal epitope recognized by T cell line 1BA4, corresponding to residues 71-84.

SEQ ID NO:2109 is the DNA sequence corresponding to SEQ ID NO:2108.

SEQ ID NO:2110 is the amino acid sequence of a L978P minimal epitope recognized by T cell line 1BF8, corresponding to residues 56-70.

SEQ ID NO:2111 is the DNA sequence corresponding to SEQ ID NO:2110.

SEQ ID NO:2112 is the amino acid sequence of a L978P minimal epitope recognized by T cell line 1BF8, corresponding to residues 91-100.

SEQ ID NO:2113 is the DNA sequence corresponding to SEQ ID NO:2112.

SEQ ID NO:2114 is the amino acid sequence of a L978P minimal epitope recognized by T cell line 2BA4, corresponding to residues 455-470.

SEQ ID NO:2115 is the DNA sequence corresponding to SEQ ID NO:2114.

SEQ ID NO:2116 is the amino acid sequence of a L978P minimal epitope recognized by T cell line 2BG7, corresponding to residues 416-430.

SEQ ID NO:2117 is the DNA sequence corresponding to SEQ ID NO:2116.

SEQ ID NO:2119-2142 are the amino acid sequences of a series of L984P 20-mer peptides overlapping by 10 amino acids, corresponding to peptides 1-24.

SEQ ID NOs:2143-2157 are the amino acid sequences of a series of L552S 20-mer peptides overlapping by 10 amino acid residues, corresponding to peptides 1-15.

DETAILED DESCRIPTION OF THE INVENTION

All of the above U.S. patents, U.S. patent application publications, U.S. patent applications, foreign patents, foreign patent applications and non-patent publications referred to in this specification and/or listed in the Application Data Sheet, are incorporated herein by reference, in their entirety.

The present invention is directed generally to compositions and their use in the therapy and diagnosis of cancer, particularly lung cancer. As described further below, illustrative compositions of the present invention include, but are not restricted to, polypeptides, particularly immunogenic polypeptides, polynucleotides encoding such polypeptides, antibodies and other binding agents, antigen presenting cells (APCs) and immune system cells (e.g., T cells).

The practice of the present invention will employ, unless indicated specifically to the contrary, conventional methods of virology, immunology, microbiology, molecular biology and recombinant DNA techniques within the skill of the art, many of which are described below for the purpose of illustration. Such techniques are explained fully in the literature. See, e.g., Sambrook, et al. Molecular Cloning: A Laboratory Manual (2nd Edition, 1989); Maniatis et al. Molecular Cloning: A Laboratory Manual (1982); DNA Cloning: A Practical Approach, vol. I & II (D. Glover, ed.); Oligonucleotide Synthesis (N. Gait, ed., 1984); Nucleic Acid Hybridization (B. Hames & S. Higgins, eds., 1985); Transcription and Translation (B. Hames & S. Higgins, eds., 1984); Animal Cell Culture (R. Freshney, ed., 1986); Perbal, A Practical Guide to Molecular Cloning (1984).

All publications, patents and patent applications cited herein, whether supra or infra, are hereby incorporated by reference in their entirety.

As used in this specification and the appended claims, the singular forms "a," "an" and "the" include plural references unless the content clearly dictates otherwise.

Polypeptide Compositions

As used herein, the term "polypeptide" "is used in its conventional meaning, i.e., as a sequence of amino acids. The polypeptides are not limited to a specific length of the product; thus, peptides, oligopeptides, and proteins are included within the definition of polypeptide, and such terms may be used interchangeably herein unless specifically indicated otherwise. This term also does not refer to or exclude post-expression modifications of the polypeptide, for example, glycosylations, acetylations, phosphorylations and the like, as well as other modifications known in the art, both naturally occurring and non-naturally occurring. A polypeptide may be an entire protein, or a subsequence thereof. Particular polypeptides of interest in the context of this invention are amino acid subsequences comprising epitopes, i.e., antigenic determinants substantially responsible for the immunogenic properties of a polypeptide and being capable of evoking an immune response.

Particularly illustrative polypeptides of the present invention comprise those encoded by a polynucleotide sequence set forth in any one of SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, and 2034-2040, or a sequence that hybridizes under moderately stringent conditions, or, alternatively, under highly stringent conditions, to a polynucleotide sequence set forth in any one of SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, and 2034-2040. Certain other illustrative polypeptides of the invention comprise amino acid sequences as set forth in any one of SEQ ID NO:324-340, 786, 787, 789, 791, 793, 795, 797-799, 805, 806, 809, 827, 1667, 1670-1675, 1677-1679, 1806-1822, 1825, 1830-1833, 1834-1856, 1863, 1864, 1869-1872, 1874, 1876, 1878, 1880, 1882, 1884-1890, 1901-1909, 1913, 1917, 1921, 1925-1930, 1932, 1934, 1937, 1940, 1942-1973, 2004, 2005-2011, 2012-2033, and 2041-2050.

The polypeptides of the present invention are sometimes herein referred to as lung tumor proteins or lung tumor polypeptides, as an indication that their identification has been based at least in part upon their increased levels of expression in lung tumor samples. Thus, a "lung tumor polypeptide" or "lung tumor protein," refers generally to a polypeptide sequence of the present invention, or a polynucleotide sequence encoding such a polypeptide, that is expressed in a substantial proportion of lung tumor samples, for example preferably greater than about 20%, more preferably greater than about 30%, and most preferably greater than about 50% or more of lung tumor samples tested, at a level that is at least two fold, and preferably at least five fold, greater than the level of expression in normal tissues, as determined using a representative assay provided herein. A lung tumor polypeptide sequence of the invention, based upon its increased level of expression in tumor cells, has particular utility both as a diagnostic marker as well as a therapeutic target, as further described below.

In certain preferred embodiments, the polypeptides of the invention are immunogenic, i.e., they react detectably within an immunoassay (such as an ELISA or T-cell stimulation assay) with antisera and/or T-cells from a patient with lung cancer. Screening for immunogenic activity can be performed using techniques well known to the skilled artisan. For example, such screens can be performed using methods such as those described in Harlow and Lane, *Antibodies: A Laboratory Manual*, Cold Spring Harbor Laboratory, 1988. In one illustrative example, a polypeptide may be immobilized on a solid support and contacted with patient sera to allow binding of antibodies within the sera to the immobilized polypeptide. Unbound sera may then be removed and bound antibodies detected using, for example, $^{125}$I-labeled Protein A.

As would be recognized by the skilled artisan, immunogenic portions of the polypeptides disclosed herein are also encompassed by the present invention. An "immunogenic portion," as used herein, is a fragment of an immunogenic polypeptide of the invention that itself is immunologically reactive (i.e., specifically binds) with the B-cells and/or T-cell surface antigen receptors that recognize the polypeptide. Immunogenic portions may generally be identified using well known techniques, such as those summarized in Paul, *Fundamental Immunology*, 3rd ed., 243-247 (Raven Press, 1993) and references cited therein. Such techniques include screening polypeptides for the ability to react with antigen-specific antibodies, antisera and/or T-cell lines or clones. As used herein, antisera and antibodies are "antigen-specific" if they specifically bind to an antigen (i.e., they react with the protein in an ELISA or other immunoassay, and do not react detectably with unrelated proteins). Such antisera and antibodies may be prepared as described herein, and using well-known techniques.

In one preferred embodiment, an immunogenic portion of a polypeptide of the present invention is a portion that reacts with antisera and/or T-cells at a level that is not substantially less than the reactivity of the full-length polypeptide (e.g., in an ELISA and/or T-cell reactivity assay). Preferably, the level of immunogenic activity of the immunogenic portion is at least about 50%, preferably at least about 70% and most preferably greater than about 90% of the immunogenicity for the full-length polypeptide. In some instances, preferred immunogenic portions will be identified that have a level of immunogenic activity greater than that of the corresponding full-length polypeptide, e.g., having greater than about 100% or 150% or more immunogenic activity.

In certain other embodiments, illustrative immunogenic portions may include peptides in which an N-terminal leader sequence and/or transmembrane domain have been deleted. Other illustrative immunogenic portions will contain a small N- and/or C-terminal deletion (e.g., 1-30 amino acids, preferably 5-15 amino acids), relative to the mature protein.

In another embodiment, a polypeptide composition of the invention may also comprise one or more polypeptides that are immunologically reactive with T cells and/or antibodies generated against a polypeptide of the invention, particularly a polypeptide having an amino acid sequence disclosed herein, or to an immunogenic fragment or variant thereof.

In another embodiment of the invention, polypeptides are provided that comprise one or more polypeptides that are capable of eliciting T cells and/or antibodies that are immunologically reactive with one or more polypeptides described herein, or one or more polypeptides encoded by contiguous nucleic acid sequences contained in the polynucleotide sequences disclosed herein, or immunogenic fragments or variants thereof, or to one or more nucleic acid sequences which hybridize to one or more of these sequences under conditions of moderate to high stringency.

The present invention, in another aspect, provides polypeptide fragments comprising at least about 5, 10, 15, 20, 25, 50, or 100 contiguous amino acids, or more, including all intermediate lengths, of a polypeptide compositions set forth herein, such as those set forth in SEQ ID NO:324-340, 786, 787, 789, 791, 793, 795, 797-799, 805, 806, 809, 827, 1667, 1670-1675, 1677-1679, 1806-1822, 1825, 1830-1833, 1834-1856, 1863, 1864, 1869-1872, 1874, 1876, 1878, 1880, 1882, 1884-1890, 1901-1909, 1913, 1917, 1921, 1925-1930, 1932, 1934, 1937, 1940, 1942-1973, 2004, 2005-2011, 2012-2033, and 2041-2050, or those encoded by a polynucleotide sequence set forth in a sequence of SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, and 2034-2040.

In another aspect, the present invention provides variants of the polypeptide compositions described herein. Polypeptide variants generally encompassed by the present invention will typically exhibit at least about 70%, 75%, 80%, 85%, 90%, 91%, 92%, 93%, 94%, 95%, 96%, 97%, 98%, or 99% or more identity (determined as described below), along its length, to a polypeptide sequences set forth herein.

In one preferred embodiment, the polypeptide fragments and variants provide by the present invention are immunologically reactive with an antibody and/or T-cell that reacts with a full-length polypeptide specifically set for the herein.

In another preferred embodiment, the polypeptide fragments and variants provided by the present invention exhibit a level of immunogenic activity of at least about 50%, preferably at least about 70%, and most preferably at least about 90% or more of that exhibited by a full-length polypeptide sequence specifically set forth herein.

A polypeptide "variant," as the term is used herein, is a polypeptide that typically differs from a polypeptide specifically disclosed herein in one or more substitutions, deletions, additions and/or insertions. Such variants may be naturally occurring or may be synthetically generated, for example, by modifying one or more of the above polypeptide sequences of the invention and evaluating their immunogenic activity as described herein and/or using any of a number of techniques well known in the art.

For example, certain illustrative variants of the polypeptides of the invention include those in which one or more portions, such as an N-terminal leader sequence or transmembrane domain, have been removed. Other illustrative variants include variants in which a small portion (e.g., 1-30 amino acids, preferably 5-15 amino acids) has been removed from the N- and/or C-terminal of the mature protein.

In many instances, a variant will contain conservative substitutions. A "conservative substitution" is one in which an amino acid is substituted for another amino acid that has similar properties, such that one skilled in the art of peptide chemistry would expect the secondary structure and hydropathic nature of the polypeptide to be substantially unchanged. As described above, modifications may be made in the structure of the polynucleotides and polypeptides of the present invention and still obtain a functional molecule that encodes a variant or derivative polypeptide with desirable characteristics, e.g., with immunogenic characteristics. When it is desired to alter the amino acid sequence of a polypeptide to create an equivalent, or even an improved, immunogenic variant or portion of a polypeptide of the invention, one skilled in the art will typically change one or more of the codons of the encoding DNA sequence according to Table 10.

For example, certain amino acids may be substituted for other amino acids in a protein structure without appreciable loss of interactive binding capacity with structures such as, for example, antigen-binding regions of antibodies or binding sites on substrate molecules. Since it is the interactive capacity and nature of a protein that defines that protein's biological functional activity, certain amino acid sequence substitutions can be made in a protein sequence, and, of course, its underlying DNA coding sequence, and nevertheless obtain a protein with like properties. It is thus contemplated that various changes may be made in the peptide sequences of the disclosed compositions, or corresponding DNA sequences which encode said peptides without appreciable loss of their biological utility or activity.

TABLE 10C

| Amino Acids | | | Codons | | | | | |
|---|---|---|---|---|---|---|---|---|
| Alanine | Ala | A | GCA | GCC | GCG | GCU | | |
| Cysteine | Cys | C | UGC | UGU | | | | |
| Aspartic acid | Asp | D | GAC | GAU | | | | |
| Glutamic acid | Glu | E | GAA | GAG | | | | |
| Phenylalanine | Phe | F | UUC | UUU | | | | |
| Glycine | Gly | G | GGA | GGC | GGG | GGU | | |
| Histidine | His | H | CAC | CAU | | | | |
| Isoleucine | Ile | I | AUA | AUC | AUU | | | |
| Lysine | Lys | K | AAA | AAG | | | | |
| Leucine | Leu | L | UUA | UUG | CUA | CUC | CUG | CUU |
| Methionine | Met | M | AUG | | | | | |
| Asparagine | Asn | N | AAC | AAU | | | | |
| Proline | Pro | P | CCA | CCC | CCG | CCU | | |
| Glutamine | Gln | Q | CAA | CAG | | | | |
| Arginine | Arg | R | AGA | AGG | CGA | CGC | CGG | CGU |
| Serine | Ser | S | AGC | AGU | UCA | UCC | UCG | UCU |
| Threonine | Thr | T | ACA | ACC | ACG | ACU | | |
| Valine | Val | V | GUA | GUC | GUG | GUU | | |
| Tryptophan | Trp | W | UGG | | | | | |
| Tyrosine | Tyr | Y | UAC | UAU | | | | |

In making such changes, the hydropathic index of amino acids may be considered. The importance of the hydropathic amino acid index in conferring interactive biologic function on a protein is generally understood in the art (Kyte and Doolittle, 1982, incorporated herein by reference). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like. Each amino acid has been assigned a hydropathic index on the basis of its hydrophobicity and charge characteristics (Kyte and Doolittle, 1982). These values are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is known in the art that certain amino acids may be substituted by other amino acids having a similar hydropathic index or score and still result in a protein with similar biological activity, i.e. still obtain a biological functionally equivalent protein. In making such changes, the substitution of amino acids whose hydropathic indices are within ±2 is preferred, those within ±1 are particularly preferred, and those within ±0.5 are even more particularly preferred. It is also understood in the art that the substitution of like amino acids can be made effectively on the basis of hydrophilicity. U.S. Pat. No. 4,554,101 (specifically incorporated herein by reference in its entirety), states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). It is understood that an amino acid can be substituted for another having a similar hydrophilicity value and still obtain a biologically equivalent, and in particular, an immunologically equivalent protein. In such changes, the substitution of amino acids whose hydrophilicity values are within ±2 is preferred, those within ±1 are particularly preferred, and those within ±0.5 are even more particularly preferred.

As outlined above, amino acid substitutions are generally therefore based on the relative similarity of the amino acid side-chain substituents, for example, their hydrophobicity, hydrophilicity, charge, size, and the like. Exemplary substitutions that take various of the foregoing characteristics into consideration are well known to those of skill in the art and include: arginine and lysine; glutamate and aspartate; serine and threonine; glutamine and asparagine; and valine, leucine and isoleucine.

In addition, any polynucleotide may be further modified to increase stability in vivo. Possible modifications include, but are not limited to, the addition of flanking sequences at the 5' and/or 3' ends; the use of phosphorothioate or 2' O-methyl rather than phosphodiesterase linkages in the backbone; and/or the inclusion of nontraditional bases such as inosine, queosine and wybutosine, as well as acetyl-methyl-, thio- and other modified forms of adenine, cytidine, guanine, thymine and uridine.

Amino acid substitutions may further be made on the basis of similarity in polarity, charge, solubility, hydrophobicity, hydrophilicity and/or the amphipatic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gln, asn, ser, thr; (2) cys, ser, tyr, thr; (3) val, ile, leu, met, ala, phe; (4) lys, arg, his; and (5) phe, tyr, trp, his. A variant may also, or alternatively, contain nonconservative changes. In a preferred embodiment, variant polypeptides differ from a native sequence by substitution, deletion or addition of five amino acids or fewer. Variants may also (or alternatively) be modified by, for example, the deletion or addition of amino acids that have minimal influence on the immunogenicity, secondary structure and hydropathic nature of the polypeptide.

As noted above, polypeptides may comprise a signal (or leader) sequence at the N-terminal end of the protein, which co-translationally or post-translationally directs transfer of the protein. The polypeptide may also be conjugated to a linker or other sequence for ease of synthesis, purification or identification of the polypeptide (e.g., poly-His), or to enhance binding of the polypeptide to a solid support. For example, a polypeptide may be conjugated to an immunoglobulin Fc region.

When comparing polypeptide sequences, two sequences are said to be "identical" if the sequence of amino acids in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345-358; Hein J. (1990) Unified Approach to Alignment and Phylogenes pp. 626-645 *Methods in Enzymology* vol. 183, Academic Press, Inc., San Diego, Calif.; Higgins, D. G. and Sharp, P. M. (1989) *CABIOS* 5:151-153; Myers, E. W. and Muller W. (1988) *CABIOS* 4:11-17; Robinson, E. D. (1971) *Comb. Theor* 11:105; Santou, N. Nes, M. (1987) *Mol. Biol. Evol.* 4:406-425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726-730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al. (1977) *Nucl. Acids Res.* 25:3389-3402 and Altschul et al. (1990) *J. Mol. Biol.* 215:403-410, respectively. BLAST and BLAST 2.0 can be used, for example with the parameters described herein, to determine percent sequence identity for the polynucleotides and polypeptides of the invention. Software for performing BLAST analyses is publicly available through the National Center for Biotechnology Information. For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment.

In one preferred approach, the "percentage of sequence identity" is determined by comparing two optimally aligned sequences over a window of comparison of at least 20 positions, wherein the portion of the polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical amino acid residue occurs in both sequences to yield the number of matched positions, dividing the number of matched positions by the total number of positions in the reference sequence (i.e., the window size) and multiplying the results by 100 to yield the percentage of sequence identity.

Within other illustrative embodiments, a polypeptide may be a fusion polypeptide that comprises multiple polypeptides as described herein, or that comprises at least one polypeptide as described herein and an unrelated sequence, such as a known tumor protein. A fusion partner may, for example, assist in providing T helper epitopes (an immunological fusion partner), preferably T helper epitopes recognized by humans, or may assist in expressing the protein (an expression enhancer) at higher yields than the native recombinant protein. Certain preferred fusion partners are both immunological and expression enhancing fusion partners. Other fusion partners may be selected so as to increase the solubility of the polypeptide or to enable the polypeptide to be targeted to desired intracellular compartments. Still further fusion partners include affinity tags, which facilitate purification of the polypeptide.

Fusion polypeptides may generally be prepared using standard techniques, including chemical conjugation. Preferably, a fusion polypeptide is expressed as a recombinant polypeptide, allowing the production of increased levels, relative to a non-fused polypeptide, in an expression system. Briefly, DNA sequences encoding the polypeptide components may be assembled separately, and ligated into an appropriate expression vector. The 3' end of the DNA sequence encoding one polypeptide component is ligated, with or without a peptide linker, to the 5' end of a DNA sequence encoding the second polypeptide component so that the reading frames of the sequences are in phase. This permits translation into a single fusion polypeptide that retains the biological activity of both component polypeptides.

A peptide linker sequence may be employed to separate the first and second polypeptide components by a distance sufficient to ensure that each polypeptide folds into its secondary and tertiary structures. Such a peptide linker sequence is incorporated into the fusion polypeptide using standard techniques well known in the art. Suitable peptide linker sequences may be chosen based on the following factors: (1) their ability to adopt a flexible extended conformation; (2) their inability to adopt a secondary structure that could interact with functional epitopes on the first and second polypeptides; and (3) the lack of hydrophobic or charged residues that might react with the polypeptide functional epitopes. Preferred peptide linker sequences contain Gly, Asn and Ser residues. Other near neutral amino acids, such as Thr and Ala may also be used in the linker sequence. Amino acid sequences which may be usefully employed as linkers include those disclosed in Maratea et al., *Gene* 40:39-46, 1985; Murphy et al., *Proc. Natl. Acad. Sci. USA* 83:8258-8262, 1986; U.S. Pat. No. 4,935,233 and U.S. Pat. No. 4,751, 180. The linker sequence may generally be from 1 to about 50 amino acids in length. Linker sequences are not required when the first and second polypeptides have non-essential N-terminal amino acid regions that can be used to separate the functional domains and prevent steric interference.

The ligated DNA sequences are operably linked to suitable transcriptional or translational regulatory elements. The regulatory elements responsible for expression of DNA are located only 5' to the DNA sequence encoding the first polypeptides. Similarly, stop codons required to end translation and transcription termination signals are only present 3' to the DNA sequence encoding the second polypeptide.

The fusion polypeptide can comprise a polypeptide as described herein together with an unrelated immunogenic protein, such as an immunogenic protein capable of eliciting a recall response. Examples of such proteins include tetanus, tuberculosis and hepatitis proteins (see, for example, Stoute et al. *New Engl. J. Med.*, 336:86-91, 1997).

In one preferred embodiment, the immunological fusion partner is derived from a *Mycobacterium* sp., such as a *Mycobacterium tuberculosis*-derived Ra12 fragment. Ra12 compositions and methods for their use in enhancing the expression and/or immunogenicity of heterologous polynucleotide/ polypeptide sequences is described in U.S. Patent Application 60/158,585, the disclosure of which is incorporated herein by reference in its entirety. Briefly, Ra12 refers to a polynucleotide region that is a subsequence of a *Mycobacterium tuberculosis* MTB32A nucleic acid. MTB32A is a serine protease of 32 KD molecular weight encoded by a gene in virulent and avirulent strains of *M. tuberculosis*. The nucleotide sequence and amino acid sequence of MTB32A have been described (for example, U.S. Patent Application 60/158, 585; see also, Skeiky et al., *Infection and Immun.* (1999) 67:3998-4007, incorporated herein by reference). Surprisingly, it was discovered that a 14 KD C-terminal fragment of the MTB32A coding sequence expresses at high levels on its own and remains as a soluble polypeptide throughout the purification process. Moreover, this fragment may enhance the immunogenicity of heterologous antigenic polypeptides with which it is fused. This 14 KD C-terminal fragment is referred to herein as Ra12 and represents a fragment comprising some or all of amino acid residues 192 to 323 of MTB32A.

Other preferred Ra12 polynucleotides generally comprise at least about 15 consecutive nucleotides, at least about 30 nucleotides, at least about 60 nucleotides, at least about 100 nucleotides, at least about 200 nucleotides, or at least about 300 nucleotides that encode a portion of a Ra12 polypeptide.

Ra12 polynucleotides may comprise a native sequence (i.e., an endogenous sequence that encodes a Ra12 polypeptide or a portion thereof) or may comprise a variant of such a sequence. Ra12 polynucleotide variants may contain one or more substitutions, additions, deletions and/or insertions such that the biological activity of the encoded fusion polypeptide is not substantially diminished, relative to a fusion polypeptide comprising a native Ra12 polypeptide. Variants preferably exhibit at least about 70% identity, more preferably at least about 80% identity and most preferably at least about 90% identity to a polynucleotide sequence that encodes a native Ra12 polypeptide or a portion thereof.

Within other preferred embodiments, an immunological fusion partner is derived from protein D, a surface protein of the gram-negative bacterium Haemophilus influenza B (WO 91/18926). Preferably, a protein D derivative comprises approximately the first third of the protein (e.g., the first N-terminal 100-110 amino acids), and a protein D derivative may be lipidated. Within certain preferred embodiments, the first 109 residues of a Lipoprotein D fusion partner is included on the N-terminus to provide the polypeptide with additional exogenous T-cell epitopes and to increase the expression level in *E. coli* (thus functioning as an expression enhancer). The lipid tail ensures optimal presentation of the antigen to antigen presenting cells. Other fusion partners include the non-structural protein from influenzae virus, NSI (hemaglutinin). Typically, the N-terminal 81 amino acids are used, although different fragments that include T-helper epitopes may be used.

In another embodiment, the immunological fusion partner is the protein known as LYTA, or a portion thereof (preferably a C-terminal portion). LYTA is derived from *Streptococcus pneumoniae*, which synthesizes an N-acetyl-L-alanine amidase known as amidase LYTA (encoded by the LytA gene; *Gene* 43:265-292, 1986). LYTA is an autolysin that specifically degrades certain bonds in the peptidoglycan backbone. The C-terminal domain of the LYTA protein is responsible for the affinity to the choline or to some choline analogues such as DEAE. This property has been exploited for the development of *E. coli* C-LYTA expressing plasmids useful for expression of fusion proteins. Purification of hybrid proteins containing the C-LYTA fragment at the amino terminus has been described (see *Biotechnology* 10:795-798, 1992). Within a preferred embodiment, a repeat portion of LYTA may be incorporated into a fusion polypeptide. A repeat portion is found in the C-terminal region starting at residue 178. A particularly preferred repeat portion incorporates residues 188-305.

Yet another illustrative embodiment involves fusion polypeptides, and the polynucleotides encoding them, wherein the fusion partner comprises a targeting signal capable of directing a polypeptide to the endosomal/lysosomal compartment, as described in U.S. Pat. No. 5,633,234. An immunogenic polypeptide of the invention, when fused with this targeting signal, will associate more efficiently with MHC class II molecules and thereby provide enhanced in vivo stimulation of $CD4^+$ T-cells specific for the polypeptide.

Polypeptides of the invention are prepared using any of a variety of well known synthetic and/or recombinant techniques, the latter of which are further described below. Polypeptides, portions and other variants generally less than about 150 amino acids can be generated by synthetic means, using techniques well known to those of ordinary skill in the art. In one illustrative example, such polypeptides are synthesized using any of the commercially available solid-phase techniques, such as the Merrifield solid-phase synthesis method, where amino acids are sequentially added to a growing amino acid chain. See Merrifield, *J. Am. Chem. Soc.* 85:2149-2146, 1963. Equipment for automated synthesis of polypeptides is commercially available from suppliers such as Perkin Elmer/Applied BioSystems Division (Foster City, Calif.), and may be operated according to the manufacturer's instructions.

In general, polypeptide compositions (including fusion polypeptides) of the invention are isolated. An "isolated" polypeptide is one that is removed from its original environment. For example, a naturally-occurring protein or polypeptide is isolated if it is separated from some or all of the coexisting materials in the natural system. Preferably, such polypeptides are also purified, e.g., are at least about 90% pure, more preferably at least about 95% pure and most preferably at least about 99% pure.

Polynucleotide Compositions

The present invention, in other aspects, provides polynucleotide compositions. The terms "DNA" and "polynucleotide" are used essentially interchangeably herein to refer to a DNA molecule that has been isolated free of total genomic DNA of a particular species. "Isolated," as used herein, means that a polynucleotide is substantially away from other coding sequences, and that the DNA molecule does not contain large portions of unrelated coding DNA, such as large chromosomal fragments or other functional genes or polypeptide coding regions. Of course, this refers to the DNA molecule as originally isolated, and does not exclude genes or coding regions later added to the segment by the hand of man.

As will be understood by those skilled in the art, the polynucleotide compositions of this invention can include genomic sequences, extra-genomic and plasmid-encoded sequences and smaller engineered gene segments that express, or may be adapted to express, proteins, polypeptides, peptides and the like. Such segments may be naturally isolated, or modified synthetically by the hand of man.

As will be also recognized by the skilled artisan, polynucleotides of the invention may be single-stranded (coding or antisense) or double-stranded, and may be DNA (genomic, cDNA or synthetic) or RNA molecules. RNA molecules may include HnRNA molecules, which contain introns and correspond to a DNA molecule in a one-to-one manner, and mRNA molecules, which do not contain introns. Additional coding or non-coding sequences may, but need not, be present within a polynucleotide of the present invention, and a polynucleotide may, but need not, be linked to other molecules and/or support materials.

Polynucleotides may comprise a native sequence (i.e., an endogenous sequence that encodes a polypeptide/protein of the invention or a portion thereof) or may comprise a sequence that encodes a variant or derivative, preferably and immunogenic variant or derivative, of such a sequence.

Therefore, according to another aspect of the present invention, polynucleotide compositions are provided that comprise some or all of a polynucleotide sequence set forth in any one of SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, and 2034-2040, complements of a polynucleotide sequence set forth in any one of SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, and 2034-2040, and degenerate variants of a polynucleotide sequence set forth in any one of SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, and 2034-2040. In certain preferred embodiments, the polynucleotide sequences set forth herein encode immunogenic polypeptides, as described above.

In other related embodiments, the present invention provides polynucleotide variants having substantial identity to the sequences disclosed herein in SEQ ID NO:1-323, 341-782, 784-785, 788, 790, 792, 794, 796, 800-804, 807, 808, 810-826, 828-1664, 1668, 1669, 1676, 1680-1805, 1823, 1824, 1826-1829, 1861, 1862, 1865-1868, 1873, 1875, 1877, 1879, 1881, 1883, 1891-1900, 1910, 1914, 1918, 1922-1924, 1931, 1933, 1938, 1941, 1974-2002, 2003, and 2034-2040, for example those comprising at least 70% sequence identity, preferably at least 75%, 80%, 85%, 90%, 95%, 96%, 97%, 98%, or 99% or higher, sequence identity compared to a polynucleotide sequence of this invention using the methods described herein, (e.g., BLAST analysis using standard parameters, as described below). One skilled in this art will recognize that these values can be appropriately adjusted to determine corresponding identity of proteins encoded by two nucleotide sequences by taking into account codon degeneracy, amino acid similarity, reading frame positioning and the like.

Typically, polynucleotide variants will contain one or more substitutions, additions, deletions and/or insertions, preferably such that the immunogenicity of the polypeptide encoded by the variant polynucleotide is not substantially diminished relative to a polypeptide encoded by a polynucleotide sequence specifically set forth herein). The term "variants" should also be understood to encompasses homologous genes of xenogenic origin.

In additional embodiments, the present invention provides polynucleotide fragments comprising various lengths of contiguous stretches of sequence identical to or complementary to one or more of the sequences disclosed herein. For example, polynucleotides are provided by this invention that comprise at least about 10, 15, 20, 30, 40, 50, 75, 100, 150, 200, 300, 400, 500 or 1000 or more contiguous nucleotides of one or more of the sequences disclosed herein as well as all intermediate lengths there between. It will be readily understood that "intermediate lengths", in this context, means any length between the quoted values, such as 16, 17, 18, 19, etc.; 21, 22, 23, etc.; 30, 31, 32, etc.; 50, 51, 52, 53, etc.; 100, 101, 102, 103, etc.; 150, 151, 152, 153, etc.; including all integers through 200-500; 500-1,000, and the like.

In another embodiment of the invention, polynucleotide compositions are provided that are capable of hybridizing under moderate to high stringency conditions to a polynucleotide sequence provided herein, or a fragment thereof, or a complementary sequence thereof. Hybridization techniques are well known in the art of molecular biology. For purposes of illustration, suitable moderately stringent conditions for testing the hybridization of a polynucleotide of this invention with other polynucleotides include prewashing in a solution of 5×SSC, 0.5% SDS, 1.0 mM EDTA (pH 8.0); hybridizing at 50° C.-60° C., 5×SSC, overnight; followed by washing twice at 65° C. for 20 minutes with each of 2×, 0.5× and 0.2×SSC containing 0.1% SDS. One skilled in the art will understand that the stringency of hybridization can be readily manipulated, such as by altering the salt content of the hybridization solution and/or the temperature at which the hybridization is performed. For example, in another embodiment, suitable highly stringent hybridization conditions include those described above, with the exception that the temperature of hybridization is increased, e.g., to 60-65° C. or 65-70° C.

In certain preferred embodiments, the polynucleotides described above, e.g., polynucleotide variants, fragments and hybridizing sequences, encode polypeptides that are immunologically cross-reactive with a polypeptide sequence specifically set forth herein. In other preferred embodiments, such polynucleotides encode polypeptides that have a level of immunogenic activity of at least about 50%, preferably at least about 70%, and more preferably at least about 90% of that for a polypeptide sequence specifically set forth herein.

The polynucleotides of the present invention, or fragments thereof, regardless of the length of the coding sequence itself, may be combined with other DNA sequences, such as promoters, polyadenylation signals, additional restriction enzyme sites, multiple cloning sites, other coding segments, and the like, such that their overall length may vary considerably. It is therefore contemplated that a nucleic acid fragment of almost any length may be employed, with the total length preferably being limited by the ease of preparation and use in the intended recombinant DNA protocol. For example, illustrative polynucleotide segments with total lengths of about 10,000, about 5000, about 3000, about 2,000, about 1,000, about 500, about 200, about 100, about 50 base pairs in length, and the like, (including all intermediate lengths) are contemplated to be useful in many implementations of this invention.

When comparing polynucleotide sequences, two sequences are said to be "identical" if the sequence of nucleotides in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345-358; Hein J. (1990) Unified Approach to Alignment and Phylogenes pp. 626-645 *Methods in Enzymology* vol. 183, Academic Press, Inc., San Diego, Calif.; Higgins, D. G. and Sharp, P. M. (1989) *CABIOS* 5:151-153; Myers, E. W. and Muller W. (1988) *CABIOS* 4:11-17; Robinson, E. D. (1971) *Comb. Theor* 11:105; Santou, N. Nes, M. (1987) *Mol. Biol. Evol.* 4:406-425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726-730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al. (1977) *Nucl. Acids Res.* 25:3389-3402 and Altschul et al. (1990) *J. Mol. Biol.* 215:403-410, respectively. BLAST and BLAST 2.0 can be used, for example with the parameters described herein, to determine percent sequence identity for the polynucleotides of the invention. Software for performing BLAST analyses is publicly available through the National Center for Biotechnology Information. In one illustrative example, cumulative scores can be calculated using, for nucleotide sequences, the parameters M (reward score for a pair of matching residues; always >0) and N (penalty score for mismatching residues; always <0). Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, and expectation (E) of 10, and the BLOSUM62 scoring matrix (see Henikoff and Henikoff (1989) *Proc. Natl. Acad. Sci. USA* 89:10915) alignments, (B) of 50, expectation (E) of 10, M=5, N=−4 and a comparison of both strands.

Preferably, the "percentage of sequence identity" is determined by comparing two optimally aligned sequences over a window of comparison of at least 20 positions, wherein the portion of the polynucleotide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases occurs in both sequences to yield the number of matched positions, dividing the number of matched positions by the total number of positions in the reference sequence (i.e., the window size) and multiplying the results by 100 to yield the percentage of sequence identity.

It will be appreciated by those of ordinary skill in the art that, as a result of the degeneracy of the genetic code, there are many nucleotide sequences that encode a polypeptide as described herein. Some of these polynucleotides bear minimal homology to the nucleotide sequence of any native gene. Nonetheless, polynucleotides that vary due to differences in codon usage are specifically contemplated by the present invention. Further, alleles of the genes comprising the polynucleotide sequences provided herein are within the scope of the present invention. Alleles are endogenous genes that are altered as a result of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

Therefore, in another embodiment of the invention, a mutagenesis approach, such as site-specific mutagenesis, is employed for the preparation of immunogenic variants and/or derivatives of the polypeptides described herein. By this approach, specific modifications in a polypeptide sequence can be made through mutagenesis of the underlying polynucleotides that encode them. These techniques provides a straightforward approach to prepare and test sequence variants, for example, incorporating one or more of the foregoing considerations, by introducing one or more nucleotide sequence changes into the polynucleotide.

Site-specific mutagenesis allows the production of mutants through the use of specific oligonucleotide sequences which encode the DNA sequence of the desired mutation, as well as a sufficient number of adjacent nucleotides, to provide a primer sequence of sufficient size and sequence complexity to form a stable duplex on both sides of the deletion junction being traversed. Mutations may be employed in a selected polynucleotide sequence to improve, alter, decrease, modify, or otherwise change the properties of the polynucleotide itself, and/or alter the properties, activity, composition, stability, or primary sequence of the encoded polypeptide.

In certain embodiments of the present invention, the inventors contemplate the mutagenesis of the disclosed polynucleotide sequences to alter one or more properties of the encoded polypeptide, such as the immunogenicity of a polypeptide vaccine. The techniques of site-specific mutagenesis are well-known in the art, and are widely used to create variants of both polypeptides and polynucleotides. For example, site-specific mutagenesis is often used to alter a specific portion of a DNA molecule. In such embodiments, a primer comprising typically about 14 to about 25 nucleotides or so in length is employed, with about 5 to about 10 residues on both sides of the junction of the sequence being altered.

As will be appreciated by those of skill in the art, site-specific mutagenesis techniques have often employed a phage vector that exists in both a single stranded and double stranded form. Typical vectors useful in site-directed mutagenesis include vectors such as the M13 phage. These phage are readily commercially-available and their use is generally well-known to those skilled in the art. Double-stranded plasmids are also routinely employed in site directed mutagenesis that eliminates the step of transferring the gene of interest from a plasmid to a phage.

In general, site-directed mutagenesis in accordance herewith is performed by first obtaining a single-stranded vector or melting apart of two strands of a double-stranded vector that includes within its sequence a DNA sequence that encodes the desired peptide. An oligonucleotide primer bearing the desired mutated sequence is prepared, generally synthetically. This primer is then annealed with the single-stranded vector, and subjected to DNA polymerizing enzymes such as *E. coli* polymerase I Klenow fragment, in order to complete the synthesis of the mutation-bearing strand. Thus, a heteroduplex is formed wherein one strand encodes the original non-mutated sequence and the second strand bears the desired mutation. This heteroduplex vector is then used to transform appropriate cells, such as *E. coli* cells, and clones are selected which include recombinant vectors bearing the mutated sequence arrangement.

The preparation of sequence variants of the selected peptide-encoding DNA segments using site-directed mutagenesis provides a means of producing potentially useful species and is not meant to be limiting as there are other ways in which sequence variants of peptides and the DNA sequences encoding them may be obtained. For example, recombinant vectors encoding the desired peptide sequence may be treated with mutagenic agents, such as hydroxylamine, to obtain sequence variants. Specific details regarding these methods and protocols are found in the teachings of Maloy et al., 1994; Segal, 1976; Prokop and Bajpai, 1991; Kuby, 1994; and Maniatis et al., 1982, each incorporated herein by reference, for that purpose.

As used herein, the term "oligonucleotide directed mutagenesis procedure" refers to template-dependent processes and vector-mediated propagation which result in an increase in the concentration of a specific nucleic acid molecule relative to its initial concentration, or in an increase in the concentration of a detectable signal, such as amplification. As used herein, the term "oligonucleotide directed mutagenesis procedure" is intended to refer to a process that involves the template-dependent extension of a primer molecule. The term template dependent process refers to nucleic acid synthesis of an RNA or a DNA molecule wherein the sequence of the newly synthesized strand of nucleic acid is dictated by the well-known rules of complementary base pairing (see, for example, Watson, 1987). Typically, vector mediated methodologies involve the introduction of the nucleic acid fragment into a DNA or RNA vector, the clonal amplification of the vector, and the recovery of the amplified nucleic acid fragment. Examples of such methodologies are provided by U.S. Pat. No. 4,237,224, specifically incorporated herein by reference in its entirety.

In another approach for the production of polypeptide variants of the present invention, recursive sequence recombination, as described in U.S. Pat. No. 5,837,458, may be employed. In this approach, iterative cycles of recombination and screening or selection are performed to "evolve" individual polynucleotide variants of the invention having, for example, enhanced immunogenic activity.

In other embodiments of the present invention, the polynucleotide sequences provided herein can be advantageously used as probes or primers for nucleic acid hybridization. As such, it is contemplated that nucleic acid segments that comprise a sequence region of at least about 15 nucleotide long contiguous sequence that has the same sequence as, or is complementary to, a 15 nucleotide long contiguous sequence disclosed herein will find particular utility. Longer contiguous identical or complementary sequences, e.g., those of about 20, 30, 40, 50, 100, 200, 500, 1000 (including all intermediate lengths) and even up to full length sequences will also be of use in certain embodiments.

The ability of such nucleic acid probes to specifically hybridize to a sequence of interest will enable them to be of use in detecting the presence of complementary sequences in a given sample. However, other uses are also envisioned, such as the use of the sequence information for the preparation of mutant species primers, or primers for use in preparing other genetic constructions.

Polynucleotide molecules having sequence regions consisting of contiguous nucleotide stretches of 10-14, 15-20, 30, 50, or even of 100-200 nucleotides or so (including intermediate lengths as well), identical or complementary to a polynucleotide sequence disclosed herein, are particularly contemplated as hybridization probes for use in, e.g., Southern and Northern blotting. This would allow a gene product, or fragment thereof, to be analyzed, both in diverse cell types and also in various bacterial cells. The total size of fragment, as well as the size of the complementary stretch(es), will ultimately depend on the intended use or application of the particular nucleic acid segment. Smaller fragments will generally find use in hybridization embodiments, wherein the length of the contiguous complementary region may be varied, such as between about 15 and about 100 nucleotides, but larger contiguous complementarity stretches may be used, according to the length complementary sequences one wishes to detect.

The use of a hybridization probe of about 15-25 nucleotides in length allows the formation of a duplex molecule that is both stable and selective. Molecules having contiguous complementary sequences over stretches greater than 15 bases in length are generally preferred, though, in order to increase stability and selectivity of the hybrid, and thereby improve the quality and degree of specific hybrid molecules obtained. One will generally prefer to design nucleic acid molecules having gene-complementary stretches of 15 to 25 contiguous nucleotides, or even longer where desired.

Hybridization probes may be selected from any portion of any of the sequences disclosed herein. All that is required is to review the sequences set forth herein, or to any continuous portion of the sequences, from about 15-25 nucleotides in length up to and including the full length sequence, that one wishes to utilize as a probe or primer. The choice of probe and primer sequences may be governed by various factors. For example, one may wish to employ primers from towards the termini of the total sequence.

Small polynucleotide segments or fragments may be readily prepared by, for example, directly synthesizing the fragment by chemical means, as is commonly practiced using an automated oligonucleotide synthesizer. Also, fragments may be obtained by application of nucleic acid reproduction technology, such as the PCR™ technology of U.S. Pat. No. 4,683,202 (incorporated herein by reference), by introducing selected sequences into recombinant vectors for recombinant production, and by other recombinant DNA techniques generally known to those of skill in the art of molecular biology.

The nucleotide sequences of the invention may be used for their ability to selectively form duplex molecules with complementary stretches of the entire gene or gene fragments of interest. Depending on the application envisioned, one will typically desire to employ varying conditions of hybridization to achieve varying degrees of selectivity of probe towards target sequence. For applications requiring high selectivity, one will typically desire to employ relatively stringent conditions to form the hybrids, e.g., one will select relatively low salt and/or high temperature conditions, such as provided by a salt concentration of from about 0.02 M to about 0.15 M salt at temperatures of from about 50° C. to about 70° C. Such selective conditions tolerate little, if any, mismatch between the probe and the template or target strand, and would be particularly suitable for isolating related sequences.

Of course, for some applications, for example, where one desires to prepare mutants employing a mutant primer strand hybridized to an underlying template, less stringent (reduced stringency) hybridization conditions will typically be needed in order to allow formation of the heteroduplex. In these circumstances, one may desire to employ salt conditions such as those of from about 0.15 M to about 0.9 M salt, at temperatures ranging from about 20° C. to about 55° C. Cross-hybridizing species can thereby be readily identified as positively hybridizing signals with respect to control hybridizations. In any case, it is generally appreciated that conditions can be rendered more stringent by the addition of increasing amounts of formamide, which serves to destabilize the hybrid duplex in the same manner as increased temperature. Thus, hybridization conditions can be readily manipulated, and thus will generally be a method of choice depending on the desired results.

According to another embodiment of the present invention, polynucleotide compositions comprising antisense oligonucleotides are provided. Antisense oligonucleotides have been demonstrated to be effective and targeted inhibitors of protein synthesis, and, consequently, provide a therapeutic approach by which a disease can be treated by inhibiting the synthesis of proteins that contribute to the disease. The efficacy of antisense oligonucleotides for inhibiting protein synthesis is well established. For example, the synthesis of polygalactauronase and the muscarine type 2 acetylcholine receptor are inhibited by antisense oligonucleotides directed to their respective mRNA sequences (U.S. Pat. No. 5,739,119 and U.S. Pat. No. 5,759,829). Further, examples of antisense inhibition have been demonstrated with the nuclear protein cyclin, the multiple drug resistance gene (MDG1), ICAM-1, E-selectin, STK-1, striatal $GABA_A$ receptor and human EGF (Jaskulski et al., Science. 1988 Jun. 10;240(4858):1544-6; Vasanthakumar and Ahmed, Cancer Commun. 1989; 1 (4): 225-32; Peris et al., Brain Res Mol Brain Res. 1998 Jun. 15;57(2):310-20; U.S. Pat. No. 5,801,154; U.S. Pat. No. 5,789,573; U.S. Pat. No. 5,718,709 and U.S. Pat. No. 5,610, 288). Antisense constructs have also been described that inhibit and can be used to treat a variety of abnormal cellular proliferations, e.g. cancer (U.S. Pat. No. 5,747,470; U.S. Pat. No. 5,591,317 and U.S. Pat. No. 5,783,683).

Therefore, in certain embodiments, the present invention provides oligonucleotide sequences that comprise all, or a portion of, any sequence that is capable of specifically binding to polynucleotide sequence described herein, or a complement thereof. In one embodiment, the antisense oligonucleotides comprise DNA or derivatives thereof. In another embodiment, the oligonucleotides comprise RNA or derivatives thereof. In a third embodiment, the oligonucleotides are modified DNAs comprising a phosphorothioated modified backbone. In a fourth embodiment, the oligonucleotide sequences comprise peptide nucleic acids or derivatives thereof. In each case, preferred compositions comprise a sequence region that is complementary, and more preferably substantially-complementary, and even more preferably, completely complementary to one or more portions of polynucleotides disclosed herein. Selection of antisense compositions specific for a given gene sequence is based upon analysis of the chosen target sequence and determination of secondary structure, $T_m$, binding energy, and relative stability. Antisense compositions may be selected based upon their relative inability to form dimers, hairpins, or other secondary structures that would reduce or prohibit specific binding to the target mRNA in a host cell. Highly preferred target regions of the mRNA, are those which are at or near the AUG translation initiation codon, and those sequences which are substantially complementary to 5' regions of the mRNA. These secondary structure analyses and target site selection considerations can be performed, for example, using v.4 of the OLIGO primer analysis software and/or the BLASTN 2.0.5 algorithm software (Altschul et al., Nucleic Acids Res. 1997, 25(17):3389-402).

The use of an antisense delivery method employing a short peptide vector, termed MPG (27 residues), is also contemplated. The MPG peptide contains a hydrophobic domain derived from the fusion sequence of HIV gp41 and a hydrophilic domain from the nuclear localization sequence of SV40 T-antigen (Morris et al., Nucleic Acids Res. 1997 Jul. 15;25(14):2730-6). It has been demonstrated that several molecules of the MPG peptide coat the antisense oligonucleotides and can be delivered into cultured mammalian cells in less than 1 hour with relatively high efficiency (90%). Further, the interaction with MPG strongly increases both the stability of the oligonucleotide to nuclease and the ability to cross the plasma membrane.

According to another embodiment of the invention, the polynucleotide compositions described herein are used in the design and preparation of ribozyme molecules for inhibiting expression of the tumor polypeptides and proteins of the present invention in tumor cells. Ribozymes are RNA-protein complexes that cleave nucleic acids in a site-specific fashion. Ribozymes have specific catalytic domains that possess endonuclease activity (Kim and Cech, Proc Natl Acad Sci USA. 1987 December;84(24):8788-92; Forster and Symons, Cell. 1987 Apr. 24;49(2):211-20). For example, a large number of ribozymes accelerate phosphoester transfer reactions with a high degree of specificity, often cleaving only one of several phosphoesters in an oligonucleotide substrate (Cech et al., Cell. 1981 December;27(3 Pt 2):487-96; Michel and Westhof, J Mol. Biol. 1990 Dec. 5;216(3):585-610; Reinhold-Hurek and Shub, Nature. 1992 May 14;357(6374):173-6). This specificity has been attributed to the requirement that the substrate bind via specific base-pairing interactions to the internal guide sequence ("IGS") of the ribozyme prior to chemical reaction.

Six basic varieties of naturally-occurring enzymatic RNAs are known presently. Each can catalyze the hydrolysis of RNA phosphodiester bonds in trans (and thus can cleave other RNA molecules) under physiological conditions. In general, enzymatic nucleic acids act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

The enzymatic nature of a ribozyme is advantageous over many technologies, such as antisense technology (where a nucleic acid molecule simply binds to a nucleic acid target to block its translation) since the concentration of ribozyme necessary to affect a therapeutic treatment is lower than that of an antisense oligonucleotide. This advantage reflects the ability of the ribozyme to act enzymatically. Thus, a single ribozyme molecule is able to cleave many molecules of target RNA. In addition, the ribozyme is a highly specific inhibitor, with the specificity of inhibition depending not only on the base pairing mechanism of binding to the target RNA, but also on the mechanism of target RNA cleavage. Single mismatches, or base-substitutions, near the site of cleavage can completely eliminate catalytic activity of a ribozyme. Similar mismatches in antisense molecules do not prevent their action (Woolf et al., Proc Natl Acad Sci USA. 1992 Aug. 15;89(16):7305-9). Thus, the specificity of action of a ribozyme is greater than that of an antisense oligonucleotide binding the same RNA site.

The enzymatic nucleic acid molecule may be formed in a hammerhead, hairpin, a hepatitis δ virus, group I intron or RNaseP RNA (in association with an RNA guide sequence) or Neurospora VS RNA motif. Examples of hammerhead motifs are described by Rossi et al. Nucleic Acids Res. 1992 Sep. 11;20(17):4559-65. Examples of hairpin motifs are described by Hampel et al. (Eur. Pat. Appl. Publ. No. EP 0360257), Hampel and Tritz, Biochemistry 1989 Jun. 13;28(12):4929-33; Hampel et al., Nucleic Acids Res. 1990 Jan. 25;18(2):299-304 and U.S. Pat. No. 5,631,359. An example of the hepatitis δ virus motif is described by Perrotta and Been, Biochemistry. 1992 Dec. 1;31(47):11843-52; an example of the RNaseP motif is described by Guerrier-Takada et al., Cell. 1983 December;35(3 Pt 2):849-57; Neurospora VS RNA ribozyme motif is described by Collins (Saville and Collins, Cell. 1990 May 18;61(4):685-96; Saville and Collins, Proc Natl Acad Sci USA. 1991 Oct. 1;88(19):8826-30; Collins and Olive, Biochemistry. 1993 Mar. 23;32(11):2795-9); and an example of the Group I intron is described in (U.S. Pat. No. 4,987,071). All that is important in an enzymatic nucleic acid molecule of this invention is that it has a specific substrate binding site which is complementary to one or more of the target gene RNA regions, and that it have nucleotide sequences within or surrounding that substrate binding site which impart an RNA cleaving activity to the molecule. Thus the ribozyme constructs need not be limited to specific motifs mentioned herein.

Ribozymes may be designed as described in Int. Pat. Appl. Publ. No. WO 93/23569 and Int. Pat. Appl. Publ. No. WO 94/02595, each specifically incorporated herein by reference) and synthesized to be tested in vitro and in vivo, as described. Such ribozymes can also be optimized for delivery. While specific examples are provided, those in the art will recognize that equivalent RNA targets in other species can be utilized when necessary.

Ribozyme activity can be optimized by altering the length of the ribozyme binding arms, or chemically synthesizing ribozymes with modifications that prevent their degradation by serum ribonucleases (see e.g., Int. Pat. Appl. Publ. No. WO 92/07065; Int. Pat. Appl. Publ. No. WO 93/15187; Int. Pat. Appl. Publ. No. WO 91/03162; Eur. Pat. Appl. Publ. No.

92110298.4; U.S. Pat. No. 5,334,711; and Int. Pat. Appl. Publ. No. WO 94/13688, which describe various chemical modifications that can be made to the sugar moieties of enzymatic RNA molecules, modifications which enhance their efficacy in cells, and removal of stem II bases to shorten RNA synthesis times and reduce chemical requirements.

Sullivan et al. (Int. Pat. Appl. Publ. No. WO 94/02595) describes the general methods for delivery of enzymatic RNA molecules. Ribozymes may be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, ribozymes may be directly delivered ex vivo to cells or tissues with or without the aforementioned vehicles. Alternatively, the RNA/vehicle combination may be locally delivered by direct inhalation, by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of ribozyme delivery and administration are provided in Int. Pat. Appl. Publ. No. WO 94/02595 and Int. Pat. Appl. Publ. No. WO 93/23569, each specifically incorporated herein by reference.

Another means of accumulating high concentrations of a ribozyme(s) within cells is to incorporate the ribozyme-encoding sequences into a DNA expression vector. Transcription of the ribozyme sequences are driven from a promoter for eukaryotic RNA polymerase I (pol I), RNA polymerase II (pol II), or RNA polymerase III (pol III). Transcripts from pol II or pol III promoters will be expressed at high levels in all cells; the levels of a given pol II promoter in a given cell type will depend on the nature of the gene regulatory sequences (enhancers, silencers, etc.) present nearby. Prokaryotic RNA polymerase promoters may also be used, providing that the prokaryotic RNA polymerase enzyme is expressed in the appropriate cells Ribozymes expressed from such promoters have been shown to function in mammalian cells. Such transcription units can be incorporated into a variety of vectors for introduction into mammalian cells, including but not restricted to, plasmid DNA vectors, viral DNA vectors (such as adenovirus or adeno-associated vectors), or viral RNA vectors (such as retroviral, semliki forest virus, sindbis virus vectors).

In another embodiment of the invention, peptide nucleic acids (PNAs) compositions are provided. PNA is a DNA mimic in which the nucleobases are attached to a pseudopeptide backbone (Good and Nielsen, Antisense Nucleic Acid Drug Dev. 1997 7(4) 431-37). PNA is able to be utilized in a number methods that traditionally have used RNA or DNA. Often PNA sequences perform better in techniques than the corresponding RNA or DNA sequences and have utilities that are not inherent to RNA or DNA. A review of PNA including methods of making, characteristics of, and methods of using, is provided by Corey (*Trends Biotechnol* 1997 June; 15(6): 224-9). As such, in certain embodiments, one may prepare PNA sequences that are complementary to one or more portions of the ACE mRNA sequence, and such PNA compositions may be used to regulate, alter, decrease, or reduce the translation of ACE-specific mRNA, and thereby alter the level of ACE activity in a host cell to which such PNA compositions have been administered.

PNAs have 2-aminoethyl-glycine linkages replacing the normal phosphodiester backbone of DNA (Nielsen et al., *Science* 1991 Dec. 6;254(5037):1497-500; Hanvey et al., Science. 1992 Nov. 27;258(5087):1481-5; Hyrup and Nielsen, Bioorg Med. Chem. 1996 January;4(1):5-23). This chemistry has three important consequences: firstly, in contrast to DNA or phosphorothioate oligonucleotides, PNAs are neutral molecules; secondly, PNAs are achiral, which avoids the need to develop a stereoselective synthesis; and thirdly, PNA synthesis uses standard Boc or Fmoc protocols for solid-phase peptide synthesis, although other methods, including a modified Merrifield method, have been used.

PNA monomers or ready-made oligomers are commercially available from PerSeptive Biosystems (Framingham, Mass.). PNA syntheses by either Boc or Fmoc protocols are straightforward using manual or automated protocols (Norton et al., Bioorg Med. Chem. 1995 April;3(4):437-45). The manual protocol lends itself to the production of chemically modified PNAs or the simultaneous synthesis of families of closely related PNAs.

As with peptide synthesis, the success of a particular PNA synthesis will depend on the properties of the chosen sequence. For example, while in theory PNAs can incorporate any combination of nucleotide bases, the presence of adjacent purines can lead to deletions of one or more residues in the product. In expectation of this difficulty, it is suggested that, in producing PNAs with adjacent purines, one should repeat the coupling of residues likely to be added inefficiently. This should be followed by the purification of PNAs by reverse-phase high-pressure liquid chromatography, providing yields and purity of product similar to those observed during the synthesis of peptides.

Modifications of PNAs for a given application may be accomplished by coupling amino acids during solid-phase synthesis or by attaching compounds that contain a carboxylic acid group to the exposed N-terminal amine. Alternatively, PNAs can be modified after synthesis by coupling to an introduced lysine or cysteine. The ease with which PNAs can be modified facilitates optimization for better solubility or for specific functional requirements. Once synthesized, the identity of PNAs and their derivatives can be confirmed by mass spectrometry. Several studies have made and utilized modifications of PNAs (for example, Norton et al., Bioorg Med. Chem. 1995 April;3(4):437-45; Petersen et al., J Pept Sci. 1995 May-June;1(3):175-83; Orum et al., Biotechniques. 1995 September;19(3):472-80; Footer et al., Biochemistry. 1996 Aug. 20;35(33):10673-9; Griffith et al., Nucleic Acids Res. 1995 Aug. 11;23(15):3003-8; Pardridge et al., Proc Natl Acad Sci U S A. 1995 Jun. 6;92(12):5592-6; Boffa et al., Proc Natl Acad Sci USA. 1995 Mar. 14;92(6):1901-5; Gambacorti-Passerini et al, Blood. 1996 Aug. 15;88(4):1411-7; Armitage et al., Proc Natl Acad Sci USA. 1997 Nov. 11;94 (23):12320-5; Seeger et al., Biotechniques. 1997 September; 23(3):512-7). U.S. Pat. No. 5,700,922 discusses PNA-DNA-PNA chimeric molecules and their uses in diagnostics, modulating protein in organisms, and treatment of conditions susceptible to therapeutics.

Methods of characterizing the antisense binding properties of PNAs are discussed in Rose (Anal Chem. 1993 Dec. 15;65 (24):3545-9) and Jensen et al. (Biochemistry. 1997 Apr. 22;36 (16):5072-7). Rose uses capillary gel electrophoresis to determine binding of PNAs to their complementary oligonucleotide, measuring the relative binding kinetics and stoichiometry. Similar types of measurements were made by Jensen et al. using BIAcore™ technology.

Other applications of PNAs that have been described and will be apparent to the skilled artisan include use in DNA strand invasion, antisense inhibition, mutational analysis, enhancers of transcription, nucleic acid purification, isolation of transcriptionally active genes, blocking of transcription factor binding, genome cleavage, biosensors, in situ hybridization, and the like.

Polynucleotide Identification, Characterization and Expression

Polynucleotides compositions of the present invention may be identified, prepared and/or manipulated using any of a variety of well established techniques (see generally, Sambrook et al., *Molecular Cloning: A Laboratory Manual*, Cold Spring Harbor Laboratories, Cold Spring Harbor, N.Y., 1989, and other like references). For example, a polynucleotide may be identified, as described in more detail below, by screening a microarray of cDNAs for tumor-associated expression (i.e., expression that is at least two fold greater in a tumor than in normal tissue, as determined using a representative assay provided herein). Such screens may be performed, for example, using the microarray technology of Affymetrix, Inc. (Santa Clara, Calif.) according to the manufacturer's instructions (and essentially as described by Schena et al., *Proc. Natl. Acad. Sci. USA* 93:10614-10619, 1996 and Heller et al., *Proc. Natl. Acad. Sci. USA* 94:2150-2155, 1997). Alternatively, polynucleotides may be amplified from cDNA prepared from cells expressing the proteins described herein, such as tumor cells.

Many template dependent processes are available to amplify a target sequences of interest present in a sample. One of the best known amplification methods is the polymerase chain reaction (PCR™) which is described in detail in U.S. Pat. Nos. 4,683,195, 4,683,202 and 4,800,159, each of which is incorporated herein by reference in its entirety. Briefly, in PCR™, two primer sequences are prepared which are complementary to regions on opposite complementary strands of the target sequence. An excess of deoxynucleoside triphosphates is added to a reaction mixture along with a DNA polymerase (e.g., Taq polymerase). If the target sequence is present in a sample, the primers will bind to the target and the polymerase will cause the primers to be extended along the target sequence by adding on nucleotides. By raising and lowering the temperature of the reaction mixture, the extended primers will dissociate from the target to form reaction products, excess primers will bind to the target and to the reaction product and the process is repeated. Preferably reverse transcription and PCR™ amplification procedure may be performed in order to quantify the amount of mRNA amplified. Polymerase chain reaction methodologies are well known in the art.

Any of a number of other template dependent processes, many of which are variations of the PCR™ amplification technique, are readily known and available in the art. Illustratively, some such methods include the ligase chain reaction (referred to as LCR), described, for example, in Eur. Pat. Appl. Publ. No. 320,308 and U.S. Pat. No. 4,883,750; Qbeta Replicase, described in PCT Intl. Pat. Appl. Publ. No. PCT/US87/00880; Strand Displacement Amplification (SDA) and Repair Chain Reaction (RCR). Still other amplification methods are described in Great Britain Pat. Appl. No. 2 202 328, and in PCT Intl. Pat. Appl. Publ. No. PCT/US89/01025. Other nucleic acid amplification procedures include transcription-based amplification systems (TAS) (PCT Intl. Pat. Appl. Publ. No. WO 88/10315), including nucleic acid sequence based amplification (NASBA) and 3SR. Eur. Pat. Appl. Publ. No. 329,822 describes a nucleic acid amplification process involving cyclically synthesizing single-stranded RNA ("ssRNA"), ssDNA, and double-stranded DNA (dsDNA). PCT Intl. Pat. Appl. Publ. No. WO 89/06700 describes a nucleic acid sequence amplification scheme based on the hybridization of a promoter/primer sequence to a target single-stranded DNA ("ssDNA") followed by transcription of many RNA copies of the sequence. Other amplification methods such as "RACE" (Frohman, 1990), and "one-sided PCR" (Ohara, 1989) are also well-known to those of skill in the art.

An amplified portion of a polynucleotide of the present invention may be used to isolate a full length gene from a suitable library (e.g., a tumor cDNA library) using well known techniques. Within such techniques, a library (cDNA or genomic) is screened using one or more polynucleotide probes or primers suitable for amplification. Preferably, a library is size-selected to include larger molecules. Random primed libraries may also be preferred for identifying 5' and upstream regions of genes. Genomic libraries are preferred for obtaining introns and extending 5' sequences.

For hybridization techniques, a partial sequence may be labeled (e.g., by nick-translation or end-labeling with $^{32}P$) using well known techniques. A bacterial or bacteriophage library is then generally screened by hybridizing filters containing denatured bacterial colonies (or lawns containing phage plaques) with the labeled probe (see Sambrook et al., *Molecular Cloning: A Laboratory Manual*, Cold Spring Harbor Laboratories, Cold Spring Harbor, N.Y., 1989). Hybridizing colonies or plaques are selected and expanded, and the DNA is isolated for further analysis. cDNA clones may be analyzed to determine the amount of additional sequence by, for example, PCR using a primer from the partial sequence and a primer from the vector. Restriction maps and partial sequences may be generated to identify one or more overlapping clones. The complete sequence may then be determined using standard techniques, which may involve generating a series of deletion clones. The resulting overlapping sequences can then assembled into a single contiguous sequence. A full length cDNA molecule can be generated by ligating suitable fragments, using well known techniques.

Alternatively, amplification techniques, such as those described above, can be useful for obtaining a full length coding sequence from a partial cDNA sequence. One such amplification technique is inverse PCR (see Triglia et al., *Nucl. Acids Res.* 16:8186, 1988), which uses restriction enzymes to generate a fragment in the known region of the gene. The fragment is then circularized by intramolecular ligation and used as a template for PCR with divergent primers derived from the known region. Within an alternative approach, sequences adjacent to a partial sequence may be retrieved by amplification with a primer to a linker sequence and a primer specific to a known region. The amplified sequences are typically subjected to a second round of amplification with the same linker primer and a second primer specific to the known region. A variation on this procedure, which employs two primers that initiate extension in opposite directions from the known sequence, is described in WO 96/38591. Another such technique is known as "rapid amplification of cDNA ends" or RACE. This technique involves the use of an internal primer and an external primer, which hybridizes to a polyA region or vector sequence, to identify sequences that are 5' and 3' of a known sequence. Additional techniques include capture PCR (Lagerstrom et al., *PCR Methods Applic.* 1:111-19, 1991) and walking PCR (Parker et al., *Nucl. Acids. Res.* 19:3055-60, 1991). Other methods employing amplification may also be employed to obtain a full length cDNA sequence.

In certain instances, it is possible to obtain a full length cDNA sequence by analysis of sequences provided in an expressed sequence tag (EST) database, such as that available from GenBank. Searches for overlapping ESTs may generally be performed using well known programs (e.g., NCBI BLAST searches), and such ESTs may be used to generate a contiguous full length sequence. Full length DNA sequences may also be obtained by analysis of genomic fragments.

In other embodiments of the invention, polynucleotide sequences or fragments thereof which encode polypeptides of the invention, or fusion proteins or functional equivalents thereof, may be used in recombinant DNA molecules to direct expression of a polypeptide in appropriate host cells. Due to the inherent degeneracy of the genetic code, other DNA sequences that encode substantially the same or a functionally equivalent amino acid sequence may be produced and these sequences may be used to clone and express a given polypeptide.

As will be understood by those of skill in the art, it may be advantageous in some instances to produce polypeptide-encoding nucleotide sequences possessing non-naturally occurring codons. For example, codons preferred by a particular prokaryotic or eukaryotic host can be selected to increase the rate of protein expression or to produce a recombinant RNA transcript having desirable properties, such as a half-life which is longer than that of a transcript generated from the naturally occurring sequence.

Moreover, the polynucleotide sequences of the present invention can be engineered using methods generally known in the art in order to alter polypeptide encoding sequences for a variety of reasons, including but not limited to, alterations which modify the cloning, processing, and/or expression of the gene product. For example, DNA shuffling by random fragmentation and PCR reassembly of gene fragments and synthetic oligonucleotides may be used to engineer the nucleotide sequences. In addition, site-directed mutagenesis may be used to insert new restriction sites, alter glycosylation patterns, change codon preference, produce splice variants, or introduce mutations, and so forth.

In another embodiment of the invention, natural, modified, or recombinant nucleic acid sequences may be ligated to a heterologous sequence to encode a fusion protein. For example, to screen peptide libraries for inhibitors of polypeptide activity, it may be useful to encode a chimeric protein that can be recognized by a commercially available antibody. A fusion protein may also be engineered to contain a cleavage site located between the polypeptide-encoding sequence and the heterologous protein sequence, so that the polypeptide may be cleaved and purified away from the heterologous moiety.

Sequences encoding a desired polypeptide may be synthesized, in whole or in part, using chemical methods well known in the art (see Caruthers, M. H. et al. (1980) *Nucl. Acids Res. Symp. Ser.* 215-223, Horn, T. et al. (1980) *Nucl. Acids Res. Symp. Ser.* 225-232). Alternatively, the protein itself may be produced using chemical methods to synthesize the amino acid sequence of a polypeptide, or a portion thereof. For example, peptide synthesis can be performed using various solid-phase techniques (Roberge, J. Y. et al. (1995) *Science* 269:202-204) and automated synthesis may be achieved, for example, using the ABI 431A Peptide Synthesizer (Perkin Elmer, Palo Alto, Calif.).

A newly synthesized peptide may be substantially purified by preparative high performance liquid chromatography (e.g., Creighton, T. (1983) Proteins, Structures and Molecular Principles, WH Freeman and Co., New York, N.Y.) or other comparable techniques available in the art. The composition of the synthetic peptides may be confirmed by amino acid analysis or sequencing (e.g., the Edman degradation procedure). Additionally, the amino acid sequence of a polypeptide, or any part thereof, may be altered during direct synthesis and/or combined using chemical methods with sequences from other proteins, or any part thereof, to produce a variant polypeptide.

In order to express a desired polypeptide, the nucleotide sequences encoding the polypeptide, or functional equivalents, may be inserted into appropriate expression vector, i.e., a vector which contains the necessary elements for the transcription and translation of the inserted coding sequence. Methods which are well known to those skilled in the art may be used to construct expression vectors containing sequences encoding a polypeptide of interest and appropriate transcriptional and translational control elements. These methods include in vitro recombinant DNA techniques, synthetic techniques, and in vivo genetic recombination. Such techniques are described, for example, in Sambrook, J. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York. N.Y.

A variety of expression vector/host systems may be utilized to contain and express polynucleotide sequences. These include, but are not limited to, microorganisms such as bacteria transformed with recombinant bacteriophage, plasmid, or cosmid DNA expression vectors; yeast transformed with yeast expression vectors; insect cell systems infected with virus expression vectors (e.g., baculovirus); plant cell systems transformed with virus expression vectors (e.g., cauliflower mosaic virus, CaMV; tobacco mosaic virus, TMV) or with bacterial expression vectors (e.g., Ti or pBR322 plasmids); or animal cell systems.

The "control elements" or "regulatory sequences" present in an expression vector are those non-translated regions of the vector—enhancers, promoters, 5' and 3' untranslated regions—which interact with host cellular proteins to carry out transcription and translation. Such elements may vary in their strength and specificity. Depending on the vector system and host utilized, any number of suitable transcription and translation elements, including constitutive and inducible promoters, may be used. For example, when cloning in bacterial systems, inducible promoters such as the hybrid lacZ promoter of the PBLUESCRIPT phagemid (Stratagene, La Jolla, Calif.) or PSPORT1 plasmid (Gibco BRL, Gaithersburg, Md.) and the like may be used. In mammalian cell systems, promoters from mammalian genes or from mammalian viruses are generally preferred. If it is necessary to generate a cell line that contains multiple copies of the sequence encoding a polypeptide, vectors based on SV40 or EBV may be advantageously used with an appropriate selectable marker.

In bacterial systems, any of a number of expression vectors may be selected depending upon the use intended for the expressed polypeptide. For example, when large quantities are needed, for example for the induction of antibodies, vectors which direct high level expression of fusion proteins that are readily purified may be used. Such vectors include, but are not limited to, the multifunctional *E. Coli* cloning and expression vectors such as BLUESCRIPT (Stratagene), in which the sequence encoding the polypeptide of interest may be ligated into the vector in frame with sequences for the amino-terminal Met and the subsequent 7 residues of .beta.-galactosidase so that a hybrid protein is produced; pIN vectors (Van Heeke, G. and S. M. Schuster (1989) *J. Biol. Chem.* 264:5503-5509); and the like. pGEX Vectors (Promega, Madison, Wis.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems may be designed to include heparin, thrombin, or factor XA protease cleavage sites so that the cloned polypeptide of interest can be released from the GST moiety at will.

In the yeast, *Saccharomyces cerevisiae*, a number of vectors containing constitutive or inducible promoters such as alpha factor, alcohol oxidase, and PGH may be used. For reviews, see Ausubel et al. (supra) and Grant et al. (1987) *Methods Enzymol.* 153:516-544.

In cases where plant expression vectors are used, the expression of sequences encoding polypeptides may be driven by any of a number of promoters. For example, viral promoters such as the 35S and 19S promoters of CaMV may be used alone or in combination with the omega leader sequence from TMV (Takamatsu, N. (1987) *EMBO J.* 6:307-311. Alternatively, plant promoters such as the small subunit of RUBISCO or heat shock promoters may be used (Coruzzi, G. et al. (1984) *EMBO J.* 3:1671-1680; Broglie, R. et al. (1984) *Science* 224:838-843; and Winter, J. et al. (1991) *Results Probl. Cell Differ.* 17:85-105). These constructs can be introduced into plant cells by direct DNA transformation or pathogen-mediated transfection. Such techniques are described in a number of generally available reviews (see, for example, Hobbs, S. or Murry, L. E. in McGraw Hill Yearbook of Science and Technology (1992) McGraw Hill, New York, N.Y.; pp. 191-196).

An insect system may also be used to express a polypeptide of interest. For example, in one such system, *Autographa californica* nuclear polyhedrosis virus (AcNPV) is used as a vector to express foreign genes in *Spodoptera frugiperda* cells or in *Trichoplusia larvae*. The sequences encoding the polypeptide may be cloned into a non-essential region of the virus, such as the polyhedrin gene, and placed under control of the polyhedrin promoter. Successful insertion of the polypeptide-encoding sequence will render the polyhedrin gene inactive and produce recombinant virus lacking coat protein. The recombinant viruses may then be used to infect, for example, *S. frugiperda* cells or *Trichoplusia larvae* in which the polypeptide of interest may be expressed (Engelhard, E. K. et al. (1994) *Proc. Natl. Acad. Sci.* 91:3224-3227).

In mammalian host cells, a number of viral-based expression systems are generally available. For example, in cases where an adenovirus is used as an expression vector, sequences encoding a polypeptide of interest may be ligated into an adenovirus transcription/translation complex consisting of the late promoter and tripartite leader sequence. Insertion in a non-essential E1 or E3 region of the viral genome may be used to obtain a viable virus which is capable of expressing the polypeptide in infected host cells (Logan, J. and Shenk, T. (1984) *Proc. Natl. Acad. Sci.* 81:3655-3659). In addition, transcription enhancers, such as the Rous sarcoma virus (RSV) enhancer, may be used to increase expression in mammalian host cells.

Specific initiation signals may also be used to achieve more efficient translation of sequences encoding a polypeptide of interest. Such signals include the ATG initiation codon and adjacent sequences. In cases where sequences encoding the polypeptide, its initiation codon, and upstream sequences are inserted into the appropriate expression vector, no additional transcriptional or translational control signals may be needed. However, in cases where only coding sequence, or a portion thereof, is inserted, exogenous translational control signals including the ATG initiation codon should be provided. Furthermore, the initiation codon should be in the correct reading frame to ensure translation of the entire insert. Exogenous translational elements and initiation codons may be of various origins, both natural and synthetic. The efficiency of expression may be enhanced by the inclusion of enhancers which are appropriate for the particular cell system which is used, such as those described in the literature (Scharf, D. et al. (1994) *Results Probl. Cell Differ.* 20:125-162).

In addition, a host cell strain may be chosen for its ability to modulate the expression of the inserted sequences or to process the expressed protein in the desired fashion. Such modifications of the polypeptide include, but are not limited to, acetylation, carboxylation. glycosylation, phosphorylation, lipidation, and acylation. Post-translational processing which cleaves a "prepro" form of the protein may also be used to facilitate correct insertion, folding and/or function. Different host cells such as CHO, COS, HeLa, MDCK, HEK293, and W138, which have specific cellular machinery and characteristic mechanisms for such post-translational activities, may be chosen to ensure the correct modification and processing of the foreign protein.

For long-term, high-yield production of recombinant proteins, stable expression is generally preferred. For example, cell lines which stably express a polynucleotide of interest may be transformed using expression vectors which may contain viral origins of replication and/or endogenous expression elements and a selectable marker gene on the same or on a separate vector. Following the introduction of the vector, cells may be allowed to grow for 1-2 days in an enriched media before they are switched to selective media. The purpose of the selectable marker is to confer resistance to selection, and its presence allows growth and recovery of cells which successfully express the introduced sequences. Resistant clones of stably transformed cells may be proliferated using tissue culture techniques appropriate to the cell type.

Any number of selection systems may be used to recover transformed cell lines. These include, but are not limited to, the herpes simplex virus thymidine kinase (Wigler, M. et al. (1977) *Cell* 11:223-32) and adenine phosphoribosyltransferase (Lowy, I. et al. (1990) *Cell* 22:817-23) genes which can be employed in tk.sup.- or aprt.sup.-cells, respectively. Also, antimetabolite, antibiotic or herbicide resistance can be used as the basis for selection; for example, dhfr which confers resistance to methotrexate (Wigler, M. et al. (1980) *Proc. Natl. Acad. Sci.* 77:3567-70); npt, which confers resistance to the aminoglycosides, neomycin and G-418 (Colbere-Garapin, F. et al (1981) *J. Mol. Biol.* 150:1-14); and als or pat, which confer resistance to chlorsulfuron and phosphinotricin acetyltransferase, respectively (Murry, supra). Additional selectable genes have been described, for example, trpB, which allows cells to utilize indole in place of tryptophan, or hisD, which allows cells to utilize histinol in place of histidine (Hartman, S.C. and R. C. Mulligan (1988) *Proc. Natl. Acad. Sci.* 85:8047-51). The use of visible markers has gained popularity with such markers as anthocyanins, beta-glucuronidase and its substrate GUS, and luciferase and its substrate luciferin, being widely used not only to identify transformants, but also to quantify the amount of transient or stable protein expression attributable to a specific vector system (Rhodes, C. A. et al. (1995) *Methods Mol. Biol.* 55:121-131).

Although the presence/absence of marker gene expression suggests that the gene of interest is also present, its presence and expression may need to be confirmed. For example, if the sequence encoding a polypeptide is inserted within a marker gene sequence, recombinant cells containing sequences can be identified by the absence of marker gene function. Alternatively, a marker gene can be placed in tandem with a polypeptide-encoding sequence under the control of a single promoter. Expression of the marker gene in response to induction or selection usually indicates expression of the tandem gene as well.

Alternatively, host cells that contain and express a desired polynucleotide sequence may be identified by a variety of procedures known to those of skill in the art. These procedures include, but are not limited to, DNA-DNA or DNA-RNA hybridizations and protein bioassay or immunoassay techniques which include, for example, membrane, solution, or chip based technologies for the detection and/or quantification of nucleic acid or protein.

A variety of protocols for detecting and measuring the expression of polynucleotide-encoded products, using either polyclonal or monoclonal antibodies specific for the product are known in the art. Examples include enzyme-linked immunosorbent assay (ELISA), radioimmunoassay (RIA), and fluorescence activated cell sorting (FACS). A two-site, monoclonal-based immunoassay utilizing monoclonal antibodies reactive to two non-interfering epitopes on a given polypeptide may be preferred for some applications, but a competitive binding assay may also be employed. These and other assays are described, among other places, in Hampton, R. et al. (1990; Serological Methods, a Laboratory Manual, APS Press, St Paul. Minn.) and Maddox, D. E. et al. (1983; *J. Exp. Med.* 158:1211-1216).

A wide variety of labels and conjugation techniques are known by those skilled in the art and may be used in various nucleic acid and amino acid assays. Means for producing labeled hybridization or PCR probes for detecting sequences related to polynucleotides include oligolabeling, nick translation, end-labeling or PCR amplification using a labeled nucleotide. Alternatively, the sequences, or any portions thereof may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. These procedures may be conducted using a variety of commercially available kits. Suitable reporter molecules or labels, which may be used include radionuclides, enzymes, fluorescent, chemiluminescent, or chromogenic agents as well as substrates, cofactors, inhibitors, magnetic particles, and the like.

Host cells transformed with a polynucleotide sequence of interest may be cultured under conditions suitable for the expression and recovery of the protein from cell culture. The protein produced by a recombinant cell may be secreted or contained intracellularly depending on the sequence and/or the vector used. As will be understood by those of skill in the art, expression vectors containing polynucleotides of the invention may be designed to contain signal sequences which direct secretion of the encoded polypeptide through a prokaryotic or eukaryotic cell membrane. Other recombinant constructions may be used to join sequences encoding a polypeptide of interest to nucleotide sequence encoding a polypeptide domain which will facilitate purification of soluble proteins. Such purification facilitating domains include, but are not limited to, metal chelating peptides such as histidine-tryptophan modules that allow purification on immobilized metals, protein A domains that allow purification on immobilized immunoglobulin, and the domain utilized in the FLAGS extension/affinity purification system (Immunex Corp., Seattle, Wash.). The inclusion of cleavable linker sequences such as those specific for Factor XA or enterokinase (Invitrogen. San Diego, Calif.) between the purification domain and the encoded polypeptide may be used to facilitate purification. One such expression vector provides for expression of a fusion protein containing a polypeptide of interest and a nucleic acid encoding 6 histidine residues preceding a thioredoxin or an enterokinase cleavage site. The histidine residues facilitate purification on IMIAC (immobilized metal ion affinity chromatography) as described in Porath, J. et al. (1992, *Prot. Exp. Purif.* 3:263-281) while the enterokinase cleavage site provides a means for purifying the desired polypeptide from the fusion protein. A discussion of vectors which contain fusion proteins is provided in Kroll, D. J. et al. (1993; *DNA Cell Biol.* 12:441-453).

In addition to recombinant production methods, polypeptides of the invention, and fragments thereof, may be produced by direct peptide synthesis using solid-phase techniques (Merrifield J. (1963) *J. Am. Chem. Soc.* 85:2149-2154). Protein synthesis may be performed using manual techniques or by automation. Automated synthesis may be achieved, for example, using Applied Biosystems 431A Peptide Synthesizer (Perkin Elmer). Alternatively, various fragments may be chemically synthesized separately and combined using chemical methods to produce the full length molecule.

Antibody Compositions, Fragments Thereof and Other Binding Agents

According to another aspect, the present invention further provides binding agents, such as antibodies and antigen-binding fragments thereof, that exhibit immunological binding to a tumor polypeptide disclosed herein, or to a portion, variant or derivative thereof. An antibody, or antigen-binding fragment thereof, is said to "specifically bind," "immunogically bind," and/or is "immunologically reactive" to a polypeptide of the invention if it reacts at a detectable level (within, for example, an ELISA assay) with the polypeptide, and does not react detectably with unrelated polypeptides under similar conditions.

Immunological binding, as used in this context, generally refers to the non-covalent interactions of the type which occur between an immunoglobulin molecule and an antigen for which the immunoglobulin is specific. The strength, or affinity of immunological binding interactions can be expressed in terms of the dissociation constant ($K_d$) of the interaction, wherein a smaller $K_d$ represents a greater affinity. Immunological binding properties of selected polypeptides can be quantified using methods well known in the art. One such method entails measuring the rates of antigen-binding site/antigen complex formation and dissociation, wherein those rates depend on the concentrations of the complex partners, the affinity of the interaction, and on geometric parameters that equally influence the rate in both directions. Thus, both the "on rate constant" ($K_{on}$) and the "off rate constant" ($K_{off}$) can be determined by calculation of the concentrations and the actual rates of association and dissociation. The ratio of $K_{off}/K_{on}$ enables cancellation of all parameters not related to affinity, and is thus equal to the dissociation constant $K_d$. See, generally, Davies et al. (1990) Annual Rev. Biochem. 59:439-473.

An "antigen-binding site," or "binding portion" of an antibody refers to the part of the immunoglobulin molecule that participates in antigen binding. The antigen binding site is formed by amino acid residues of the N-terminal variable ("V") regions of the heavy ("H") and light ("L") chains. Three highly divergent stretches within the V regions of the heavy and light chains are referred to as "hypervariable regions" which are interposed between more conserved flanking stretches known as "framework regions," or "FRs". Thus the term "FR" refers to amino acid sequences which are naturally found between and adjacent to hypervariable regions in immunoglobulins. In an antibody molecule, the three hypervariable regions of a light chain and the three hypervariable regions of a heavy chain are disposed relative to each other in three dimensional space to form an antigen-binding surface. The antigen-binding surface is complementary to the three-dimensional surface of a bound antigen, and the three hypervariable regions of each of the heavy and light chains are referred to as "complementarity-determining regions," or "CDRs."

Binding agents may be further capable of differentiating between patients with and without a cancer, such as lung cancer, using the representative assays provided herein. For example, antibodies or other binding agents that bind to a tumor protein will preferably generate a signal indicating the presence of a cancer in at least about 20% of patients with the disease, more preferably at least about 30% of patients. Alternatively, or in addition, the antibody will generate a negative signal indicating the absence of the disease in at least about 90% of individuals without the cancer. To determine whether a binding agent satisfies this requirement, biological samples (e.g., blood, sera, sputum, urine and/or tumor biopsies) from patients with and without a cancer (as determined using standard clinical tests) may be assayed as described herein for the presence of polypeptides that bind to the binding agent. Preferably, a statistically significant number of samples with and without the disease will be assayed. Each binding agent should satisfy the above criteria; however, those of ordinary skill in the art will recognize that binding agents may be used in combination to improve sensitivity.

Any agent that satisfies the above requirements may be a binding agent. For example, a binding agent may be a ribosome, with or without a peptide component, an RNA molecule or a polypeptide. In a preferred embodiment, a binding agent is an antibody or an antigen-binding fragment thereof. Antibodies may be prepared by any of a variety of techniques known to those of ordinary skill in the art. See, e.g., Harlow and Lane, *Antibodies: A Laboratory Manual*, Cold Spring Harbor Laboratory, 1988. In general, antibodies can be produced by cell culture techniques, including the generation of monoclonal antibodies as described herein, or via transfection of antibody genes into suitable bacterial or mammalian cell hosts, in order to allow for the production of recombinant antibodies. In one technique, an immunogen comprising the polypeptide is initially injected into any of a wide variety of mammals (e.g., mice, rats, rabbits, sheep or goats). In this step, the polypeptides of this invention may serve as the immunogen without modification. Alternatively, particularly for relatively short polypeptides, a superior immune response may be elicited if the polypeptide is joined to a carrier protein, such as bovine serum albumin or keyhole limpet hemocyanin. The immunogen is injected into the animal host, preferably according to a predetermined schedule incorporating one or more booster immunizations, and the animals are bled periodically. Polyclonal antibodies specific for the polypeptide may then be purified from such antisera by, for example, affinity chromatography using the polypeptide coupled to a suitable solid support.

Monoclonal antibodies specific for an antigenic polypeptide of interest may be prepared, for example, using the technique of Kohler and Milstein, *Eur. J. Immunol.* 6:511-519, 1976, and improvements thereto. Briefly, these methods involve the preparation of immortal cell lines capable of producing antibodies having the desired specificity (i.e., reactivity with the polypeptide of interest). Such cell lines may be produced, for example, from spleen cells obtained from an animal immunized as described above. The spleen cells are then immortalized by, for example, fusion with a myeloma cell fusion partner, preferably one that is syngeneic with the immunized animal. A variety of fusion techniques may be employed. For example, the spleen cells and myeloma cells may be combined with a nonionic detergent for a few minutes and then plated at low density on a selective medium that supports the growth of hybrid cells, but not myeloma cells. A preferred selection technique uses HAT (hypoxanthine, aminopterin, thymidine) selection. After a sufficient time, usually about 1 to 2 weeks, colonies of hybrids are observed. Single colonies are selected and their culture supernatants tested for binding activity against the polypeptide. Hybridomas having high reactivity and specificity are preferred.

Monoclonal antibodies may be isolated from the supernatants of growing hybridoma colonies. In addition, various techniques may be employed to enhance the yield, such as injection of the hybridoma cell line into the peritoneal cavity of a suitable vertebrate host, such as a mouse. Monoclonal antibodies may then be harvested from the ascites fluid or the blood. Contaminants may be removed from the antibodies by conventional techniques, such as chromatography, gel filtration, precipitation, and extraction. The polypeptides of this invention may be used in the purification process in, for example, an affinity chromatography step.

A number of therapeutically useful molecules are known in the art which comprise antigen-binding sites that are capable of exhibiting immunological binding properties of an antibody molecule. The proteolytic enzyme papain preferentially cleaves IgG molecules to yield several fragments, two of which (the "F(ab)" fragments) each comprise a covalent heterodimer that includes an intact antigen-binding site. The enzyme pepsin is able to cleave IgG molecules to provide several fragments, including the "F(ab')$_2$" fragment which comprises both antigen-binding sites. An "Fv" fragment can be produced by preferential proteolytic cleavage of an IgM, and on rare occasions IgG or IgA immunoglobulin molecule. Fv fragments are, however, more commonly derived using recombinant techniques known in the art. The Fv fragment includes a non-covalent $V_H$::$V_L$ heterodimer including an antigen-binding site which retains much of the antigen recognition and binding capabilities of the native antibody molecule. Inbar et al. (1972) Proc. Nat. Acad. Sci. USA 69:2659-2662; Hochman et al. (1976) Biochem 15:2706-2710; and Ehrlich et al. (1980) Biochem 19:4091-4096.

A single chain Fv ("sFv") polypeptide is a covalently linked $V_H$::$V_L$ heterodimer which is expressed from a gene fusion including $V_H$- and $V_L$-encoding genes linked by a peptide-encoding linker. Huston et al. (1988) Proc. Nat. Acad. Sci. USA 85(16):5879-5883. A number of methods have been described to discern chemical structures for converting the naturally aggregated—but chemically separated—light and heavy polypeptide chains from an antibody V region into an sFv molecule which will fold into a three dimensional structure substantially similar to the structure of an antigen-binding site. See, e.g., U.S. Pat. Nos. 5,091,513 and 5,132,405, to Huston et al.; and U.S. Pat. No. 4,946,778, to Ladner et al.

Each of the above-described molecules includes a heavy chain and a light chain CDR set, respectively interposed between a heavy chain and a light chain FR set which provide support to the CDRS and define the spatial relationship of the CDRs relative to each other. As used herein, the term "CDR set" refers to the three hypervariable regions of a heavy or light chain V region. Proceeding from the N-terminus of a heavy or light chain, these regions are denoted as "CDR1," "CDR2," and "CDR3" respectively. An antigen-binding site, therefore, includes six CDRs, comprising the CDR set from each of a heavy and a light chain V region. A polypeptide comprising a single CDR, (e.g., a CDR1, CDR2 or CDR3) is referred to herein as a "molecular recognition unit." Crystallographic analysis of a number of antigen-antibody complexes has demonstrated that the amino acid residues of CDRs form extensive contact with bound antigen, wherein the most extensive antigen contact is with the heavy chain CDR3. Thus, the molecular recognition units are primarily responsible for the specificity of an antigen-binding site.

As used herein, the term "FR set" refers to the four flanking amino acid sequences which frame the CDRs of a CDR set of a heavy or light chain V region. Some FR residues may contact bound antigen; however, FRs are primarily responsible for folding the V region into the antigen-binding site, particularly the FR residues directly adjacent to the CDRS. Within FRs, certain amino residues and certain structural features are very highly conserved. In this regard, all V region sequences contain an internal disulfide loop of around 90 amino acid residues. When the V regions fold into a binding-site, the CDRs are displayed as projecting loop motifs which form an antigen-binding surface. It is generally recognized that there are conserved structural regions of FRs which influence the folded shape of the CDR loops into certain "canonical" structures—regardless of the precise CDR amino acid sequence. Further, certain FR residues are known to participate in non-covalent interdomain contacts which stabilize the interaction of the antibody heavy and light chains.

A number of "humanized" antibody molecules comprising an antigen-binding site derived from a non-human immunoglobulin have been described, including chimeric antibodies having rodent V regions and their associated CDRs fused to human constant domains (Winter et al. (1991) Nature 349: 293-299; Lobuglio et al. (1989) Proc. Nat. Acad. Sci. USA 86:4220-4224; Shaw et al. (1987) J. Immunol. 138:4534-4538; and Brown et al. (1987) Cancer Res. 47:3577-3583), rodent CDRs grafted into a human supporting FR prior to fusion with an appropriate human antibody constant domain (Riechmann et al. (1988) Nature 332:323-327; Verhoeyen et al. (1988) Science 239:1534-1536; and Jones et al. (1986) Nature 321:522-525), and rodent CDRs supported by recombinantly veneered rodent FRs (European Patent Publication No. 519,596, published Dec. 23, 1992). These "humanized" molecules are designed to minimize unwanted immunological response toward rodent antihuman antibody molecules which limits the duration and effectiveness of therapeutic applications of those moieties in human recipients.

As used herein, the terms "veneered FRs" and "recombinantly veneered FRs" refer to the selective replacement of FR residues from, e.g., a rodent heavy or light chain V region, with human FR residues in order to provide a xenogeneic molecule comprising an antigen-binding site which retains substantially all of the native FR polypeptide folding structure. Veneering techniques are based on the understanding that the ligand binding characteristics of an antigen-binding site are determined primarily by the structure and relative disposition of the heavy and light chain CDR sets within the antigen-binding surface. Davies et al. (1990) Ann. Rev. Biochem. 59:439-473. Thus, antigen binding specificity can be preserved in a humanized antibody only wherein the CDR structures, their interaction with each other, and their interaction with the rest of the V region domains are carefully maintained. By using veneering techniques, exterior (e.g., solvent-accessible) FR residues which are readily encountered by the immune system are selectively replaced with human residues to provide a hybrid molecule that comprises either a weakly immunogenic, or substantially non-immunogenic veneered surface.

The process of veneering makes use of the available sequence data for human antibody variable domains compiled by Kabat et al., in Sequences of Proteins of Immunological Interest, 4th ed., (U.S. Dept. of Health and Human Services, U.S. Government Printing Office, 1987), updates to the Kabat database, and other accessible U.S. and foreign databases (both nucleic acid and protein). Solvent accessibilities of V region amino acids can be deduced from the known three-dimensional structure for human and murine antibody fragments. There are two general steps in veneering a murine antigen-binding site. Initially, the FRs of the variable domains of an antibody molecule of interest are compared with corresponding FR sequences of human variable domains obtained from the above-identified sources. The most homologous human V regions are then compared residue by residue to corresponding murine amino acids. The residues in the murine FR which differ from the human counterpart are replaced by the residues present in the human moiety using recombinant techniques well known in the art. Residue switching is only carried out with moieties which are at least partially exposed (solvent accessible), and care is exercised in the replacement of amino acid residues which may have a significant effect on the tertiary structure of V region domains, such as proline, glycine and charged amino acids.

In this manner, the resultant "veneered" murine antigen-binding sites are thus designed to retain the murine CDR residues, the residues substantially adjacent to the CDRs, the residues identified as buried or mostly buried (solvent inaccessible), the residues believed to participate in non-covalent (e.g., electrostatic and hydrophobic) contacts between heavy and light chain domains, and the residues from conserved structural regions of the FRs which are believed to influence the "canonical" tertiary structures of the CDR loops. These design criteria are then used to prepare recombinant nucleotide sequences which combine the CDRs of both the heavy and light chain of a murine antigen-binding site into human-appearing FRs that can be used to transfect mammalian cells for the expression of recombinant human antibodies which exhibit the antigen specificity of the murine antibody molecule.

In another embodiment of the invention, monoclonal antibodies of the present invention may be coupled to one or more therapeutic agents. Suitable agents in this regard include radionuclides, differentiation inducers, drugs, toxins, and derivatives thereof. Preferred radionuclides include $^{90}$Y, $^{123}$I, $^{125}$I, $^{131}$I, $^{186}$Re, $^{188}$Re, $^{211}$At, and $^{212}$Bi. Preferred drugs include methotrexate, and pyrimidine and purine analogs. Preferred differentiation inducers include phorbol esters and butyric acid. Preferred toxins include ricin, abrin, diptheria toxin, cholera toxin, gelonin, *Pseudomonas* exotoxin, *Shigella* toxin, and pokeweed antiviral protein.

A therapeutic agent may be coupled (e.g., covalently bonded) to a suitable monoclonal antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be effected, for example, through amino groups, carboxyl groups, sulfhydryl groups or oxidized carbohydrate residues. There are numerous references describing such methodology, e.g., U.S. Pat. No. 4,671,958, to Rodwell et al.

Where a therapeutic agent is more potent when free from the antibody portion of the immunoconjugates of the present invention, it may be desirable to use a linker group which is cleavable during or upon internalization into a cell. A number of different cleavable linker groups have been described. The mechanisms for the intracellular release of an agent from these linker groups include cleavage by reduction of a disulfide bond (e.g., U.S. Pat. No. 4,489,710, to Spitler), by irradiation of a photolabile bond (e.g., U.S. Pat. No. 4,625,014, to Senter et al.), by hydrolysis of derivatized amino acid side chains (e.g., U.S. Pat. No. 4,638,045, to Kohn et al.), by serum complement-mediated hydrolysis (e.g., U.S. Pat. No. 4,671,958, to Rodwell et al.), and acid-catalyzed hydrolysis (e.g., U.S. Pat. No. 4,569,789, to Blattler et al.).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways. For example, more than one agent may be coupled directly to an antibody molecule, or linkers that provide multiple sites for attachment can be used. Alternatively, a carrier can be used.

A carrier may bear the agents in a variety of ways, including covalent bonding either directly or via a linker group. Suitable carriers include proteins such as albumins (e.g., U.S. Pat. No. 4,507,234, to Kato et al.), peptides and polysaccharides such as aminodextran (e.g., U.S. Pat. No. 4,699,784, to Shih et al.). A carrier may also bear an agent by noncovalent bonding or by encapsulation, such as within a liposome vesicle (e.g., U.S. Pat. Nos. 4,429,008 and 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, or metal oxide, radionuclide. For example, U.S. Pat. No. 4,673,562, to Davison et al. discloses representative chelating compounds and their synthesis.

T Cell Compositions

The present invention, in another aspect, provides T cells specific for a tumor polypeptide disclosed herein, or for a variant or derivative thereof. Such cells may generally be prepared in vitro or ex vivo, using standard procedures. For example, T cells may be isolated from bone marrow, peripheral blood, or a fraction of bone marrow or peripheral blood of a patient, using a commercially available cell separation system, such as the Isolex™ System, available from Nexell Therapeutics, Inc. (Irvine, Calif.; see also U.S. Pat. No. 5,240,856; U.S. Pat. No. 5,215,926; WO 89/06280; WO 91/16116 and WO 92/07243). Alternatively, T cells may be derived from related or unrelated humans, non-human mammals, cell lines or cultures.

T cells may be stimulated with a polypeptide, polynucleotide encoding a polypeptide and/or an antigen presenting cell (APC) that expresses such a polypeptide. Such stimulation is performed under conditions and for a time sufficient to permit the generation of T cells that are specific for the polypeptide of interest. Preferably, a tumor polypeptide or polynucleotide of the invention is present within a delivery vehicle, such as a microsphere, to facilitate the generation of specific T cells.

T cells are considered to be specific for a polypeptide of the present invention if the T cells specifically proliferate, secrete cytokines or kill target cells coated with the polypeptide or expressing a gene encoding the polypeptide. T cell specificity may be evaluated using any of a variety of standard techniques. For example, within a chromium release assay or proliferation assay, a stimulation index of more than two fold increase in lysis and/or proliferation, compared to negative controls, indicates T cell specificity. Such assays may be performed, for example, as described in Chen et al., *Cancer Res.* 54:1065-1070, 1994. Alternatively, detection of the proliferation of T cells may be accomplished by a variety of known techniques. For example, T cell proliferation can be detected by measuring an increased rate of DNA synthesis (e.g., by pulse-labeling cultures of T cells with tritiated thymidine and measuring the amount of tritiated thymidine incorporated into DNA). Contact with a tumor polypeptide (100 ng/ml-100 µg/ml, preferably 200 ng/ml-25 µg/ml) for 3-7 days will typically result in at least a two fold increase in proliferation of the T cells. Contact as described above for 2-3 hours should result in activation of the T cells, as measured using standard cytokine assays in which a two fold increase in the level of cytokine release (e.g., TNF or IFN-γ) is indicative of T cell activation (see Coligan et al., Current Protocols in Immunology, vol. 1, Wiley Interscience (Greene 1998)). T cells that have been activated in response to a tumor polypeptide, polynucleotide or polypeptide-expressing APC may be $CD4^+$ and/or $CD8^+$. Tumor polypeptide-specific T cells may be expanded using standard techniques. Within preferred embodiments, the T cells are derived from a patient, a related donor or an unrelated donor, and are administered to the patient following stimulation and expansion.

For therapeutic purposes, $CD4^+$ or $CD8^+$ T cells that proliferate in response to a tumor polypeptide, polynucleotide or APC can be expanded in number either in vitro or in vivo. Proliferation of such T cells in vitro may be accomplished in a variety of ways. For example, the T cells can be re-exposed to a tumor polypeptide, or a short peptide corresponding to an immunogenic portion of such a polypeptide, with or without the addition of T cell growth factors, such as interleukin-2, and/or stimulator cells that synthesize a tumor polypeptide. Alternatively, one or more T cells that proliferate in the presence of the tumor polypeptide can be expanded in number by cloning. Methods for cloning cells are well known in the art, and include limiting dilution.

T Cell Receptor Compositions

The T cell receptor (TCR) consists of 2 different, highly variable polypeptide chains, termed the T-cell receptor α and β chains, that are linked by a disulfide bond (Janeway, Travers, Walport. *Immunobiology*. Fourth Ed., 148-159. Elsevier Science Ltd/Garland Publishing. 1999). The α/β heterodimer complexes with the invariant CD3 chains at the cell membrane. This complex recognizes specific antigenic peptides bound to MHC molecules. The enormous diversity of TCR specificities is generated much like immunoglobulin diversity, through somatic gene rearrangement. The β chain genes contain over 50 variable (V), 2 diversity (D), over 10 joining (J) segments, and 2 constant region segments (C). The α chain genes contain over 70 V segments, and over 60 J segments but no D segments, as well as one C segment. During T cell development in the thymus, the D to J gene rearrangement of the β chain occurs, followed by the V gene segment rearrangement to the DJ. This functional VDJ$_β$ exon is transcribed and spliced to join to a C$_β$. For the α chain, a V$_α$ gene segment rearranges to a J$_α$ gene segment to create the functional exon that is then transcribed and spliced to the C$_α$. Diversity is further increased during the recombination process by the random addition of P and N-nucleotides between the V, D, and J segments of the β chain and between the V and J segments in the a chain (Janeway, Travers, Walport. *Immunobiology*. Fourth Ed., 98 and 150. Elsevier Science Ltd/Garland Publishing. 1999).

The present invention, in another aspect, provides TCRs specific for a polypeptide disclosed herein, or for a variant or derivative thereof. In accordance with the present invention, polynucleotide and amino acid sequences are provided for the V-J or V-D-J junctional regions or parts thereof for the alpha and beta chains of the T-cell receptor which recognize tumor polypeptides described herein. In general, this aspect of the invention relates to T-cell receptors which recognize or bind tumor polypeptides presented in the context of MHC. In a preferred embodiment the tumor antigens recognized by the T-cell receptors comprise a polypeptide of the present invention. For example, cDNA encoding a TCR specific for a tumor peptide can be isolated from T cells specific for a tumor polypeptide using standard molecular biological and recombinant DNA techniques.

This invention further includes the T-cell receptors or analogs thereof having substantially the same function or activity as the T-cell receptors of this invention which recognize or bind tumor polypeptides. Such receptors include, but are not limited to, a fragment of the receptor, or a substitution, addition or deletion mutant of a T-cell receptor provided herein. This invention also encompasses polypeptides or peptides that are substantially homologous to the T-cell receptors provided herein or that retain substantially the same activity. The term "analog" includes any protein or polypeptide having an amino acid residue sequence substantially identical to the T-cell receptors provided herein in which one or more residues, preferably no more than 5 residues, more preferably no more than 25 residues have been conservatively substituted with a functionally similar residue and which displays the functional aspects of the T-cell receptor as described herein.

The present invention further provides for suitable mammalian host cells, for example, non-specific T cells, that are transfected with a polynucleotide encoding TCRs specific for a polypeptide described herein, thereby rendering the host cell specific for the polypeptide. The α and β chains of the TCR may be contained on separate expression vectors or alternatively, on a single expression vector that also contains an internal ribosome entry site (IRES) for cap-independent translation of the gene downstream of the IRES. Said host cells expressing TCRs specific for the polypeptide may be used, for example, for adoptive immunotherapy of lung cancer as discussed further below.

In further aspects of the present invention, cloned TCRs specific for a polypeptide recited herein may be used in a kit for the diagnosis of lung cancer. For example, the nucleic acid sequence or portions thereof, of tumor-specific TCRs can be used as probes or primers for the detection of expression of the rearranged genes encoding the specific TCR in a biological sample. Therefore, the present invention further provides for an assay for detecting messenger RNA or DNA encoding the TCR specific for a polypeptide. Pharmaceutical Compositions In additional embodiments, the present invention concerns formulation of one or more of the polynucleotide, polypeptide, T-cell and/or antibody compositions disclosed herein in pharmaceutically-acceptable carriers for administration to a cell or an animal, either alone, or in combination with one or more other modalities of therapy.

It will be understood that, if desired, a composition as disclosed herein may be administered in combination with other agents as well, such as, e.g., other proteins or polypeptides or various pharmaceutically-active agents. In fact, there is virtually no limit to other components that may also be included, given that the additional agents do not cause a significant adverse effect upon contact with the target cells or host tissues. The compositions may thus be delivered along with various other agents as required in the particular instance. Such compositions may be purified from host cells or other biological sources, or alternatively may be chemically synthesized as described herein. Likewise, such compositions may further comprise substituted or derivatized RNA or DNA compositions.

Therefore, in another aspect of the present invention, pharmaceutical compositions are provided comprising one or more of the polynucleotide, polypeptide, antibody, and/or T-cell compositions described herein in combination with a physiologically acceptable carrier. In certain preferred embodiments, the pharmaceutical compositions of the invention comprise immunogenic polynucleotide and/or polypeptide compositions of the invention for use in prophylactic and theraputic vaccine applications. Vaccine preparation is generally described in, for example, M. F. Powell and M. J. Newman, eds., "Vaccine Design (the subunit and adjuvant approach)," Plenum Press (NY, 1995). Generally, such compositions will comprise one or more polynucleotide and/or polypeptide compositions of the present invention in combination with one or more immunostimulants.

It will be apparent that any of the pharmaceutical compositions described herein can contain pharmaceutically acceptable salts of the polynucleotides and polypeptides of the invention. Such salts can be prepared, for example, from pharmaceutically acceptable non-toxic bases, including organic bases (e.g., salts of primary, secondary and tertiary amines and basic amino acids) and inorganic bases (e.g., sodium, potassium, lithium, ammonium, calcium and magnesium salts).

In another embodiment, illustrative immunogenic compositions, e.g., vaccine compositions, of the present invention comprise DNA encoding one or more of the polypeptides as described above, such that the polypeptide is generated in situ. As noted above, the polynucleotide may be administered within any of a variety of delivery systems known to those of ordinary skill in the art. Indeed, numerous gene delivery techniques are well known in the art, such as those described by Rolland, *Crit. Rev. Therap. Drug Carrier Systems* 15:143-198, 1998, and references cited therein. Appropriate polynucleotide expression systems will, of course, contain the necessary regulatory DNA regulatory sequences for expression in a patient (such as a suitable promoter and terminating signal). Alternatively, bacterial delivery systems may involve the administration of a bacterium (such as *Bacillus-Calmette-Guerrin*) that expresses an immunogenic portion of the polypeptide on its cell surface or secretes such an epitope.

Therefore, in certain embodiments, polynucleotides encoding immunogenic polypeptides described herein are introduced into suitable mammalian host cells for expression using any of a number of known viral-based systems. In one illustrative embodiment, retroviruses provide a convenient and effective platform for gene delivery systems. A selected nucleotide sequence encoding a polypeptide of the present invention can be inserted into a vector and packaged in retroviral particles using techniques known in the art. The recombinant virus can then be isolated and delivered to a subject. A number of illustrative retroviral systems have been described (e.g., U.S. Pat. No. 5,219,740; Miller and Rosman (1989) BioTechniques 7:980-990; Miller, A. D. (1990) Human Gene Therapy 1:5-14; Scarpa et al. (1991) Virology 180:849-852; Burns et al. (1993) Proc. Natl. Acad. Sci. USA 90:8033-8037; and Boris-Lawrie and Temin (1993) Cur. Opin. Genet. Develop. 3:102-109.

In addition, a number of illustrative adenovirus-based systems have also been described. Unlike retroviruses which integrate into the host genome, adenoviruses persist extrachromosomally thus minimizing the risks associated with insertional mutagenesis (Haj-Ahmad and Graham (1986) J. Virol. 57:267-274; Bett et al. (1993) J. Virol. 67:5911-5921; Mittereder et al. (1994) Human Gene Therapy 5:717-729; Seth et al. (1994) J. Virol. 68:933-940; Barr et al. (1994) Gene Therapy 1:51-58; Berkner, K. L. (1988) BioTechniques 6:616-629; and Rich et al. (1993) Human Gene Therapy 4:461-476).

Various adeno-associated virus (AAV) vector systems have also been developed for polynucleotide delivery. AAV vectors can be readily constructed using techniques well known in the art. See, e.g., U.S. Pat. Nos. 5,173,414 and 5,139,941; International Publication Nos. WO 92/01070 and WO 93/03769; Lebkowski et al. (1988) Molec. Cell. Biol. 8:3988-3996; Vincent et al. (1990) Vaccines 90 (Cold Spring Harbor Laboratory Press); Carter, B. J. (1992) Current Opinion in Biotechnology 3:533-539; Muzyczka, N. (1992) Current Topics in Microbiol. and Immunol. 158:97-129; Kotin, R. M. (1994) Human Gene Therapy 5:793-801; Shelling and Smith (1994) Gene Therapy 1:165-169; and Zhou et al. (1994) J. Exp. Med. 179:1867-1875.

Additional viral vectors useful for delivering the polynucleotides encoding polypeptides of the present invention by gene transfer include those derived from the pox family of viruses, such as vaccinia virus and avian poxvirus. By way of example, vaccinia virus recombinants expressing the novel molecules can be constructed as follows. The DNA encoding a polypeptide is first inserted into an appropriate vector so that it is adjacent to a vaccinia promoter and flanking vaccinia DNA sequences, such as the sequence encoding thymidine kinase (TK). This vector is then used to transfect cells which are simultaneously infected with vaccinia. Homologous recombination serves to insert the vaccinia promoter plus the gene encoding the polypeptide of interest into the viral genome. The resulting TK.sup.(−) recombinant can be selected by culturing the cells in the presence of 5-bromodeoxyuridine and picking viral plaques resistant thereto.

A vaccinia-based infection/transfection system can be conveniently used to provide for inducible, transient expression or coexpression of one or more polypeptides described herein in host cells of an organism. In this particular system, cells are first infected in vitro with a vaccinia virus recombinant that encodes the bacteriophage T7 RNA polymerase. This polymerase displays exquisite specificity in that it only transcribes templates bearing T7 promoters. Following infection, cells are transfected with the polynucleotide or polynucleotides of interest, driven by a T7 promoter. The polymerase expressed in the cytoplasm from the vaccinia virus recombinant transcribes the transfected DNA into RNA which is then translated into polypeptide by the host translational machinery. The method provides for high level, transient, cytoplasmic production of large quantities of RNA and its translation products. See, e.g., Elroy-Stein and Moss, Proc. Natl. Acad. Sci. USA (1990) 87:6743-6747; Fuerst et al. Proc. Natl. Acad. Sci. USA (1986) 83:8122-8126.

Alternatively, avipoxviruses, such as the fowlpox and canarypox viruses, can also be used to deliver the coding sequences of interest. Recombinant avipox viruses, expressing immunogens from mammalian pathogens, are known to confer protective immunity when administered to non-avian species. The use of an Avipox vector is particularly desirable in human and other mammalian species since members of the Avipox genus can only productively replicate in susceptible avian species and therefore are not infective in mammalian cells. Methods for producing recombinant Avipoxviruses are known in the art and employ genetic recombination, as described above with respect to the production of vaccinia viruses. See, e.g., WO 91/12882; WO 89/03429; and WO 92/03545.

Any of a number of alphavirus vectors can also be used for delivery of polynucleotide compositions of the present invention, such as those vectors described in U.S. Pat. Nos. 5,843,723; 6,015,686; 6,008,035 and 6,015,694. Certain vectors based on Venezuelan Equine Encephalitis (VEE) can also be used, illustrative examples of which can be found in U.S. Pat. Nos. 5,505,947 and 5,643,576.

Moreover, molecular conjugate vectors, such as the adenovirus chimeric vectors described in Michael et al. J. Biol. Chem. (1993) 268:6866-6869 and Wagner et al. Proc. Natl. Acad. Sci. USA (1992) 89:6099-6103, can also be used for gene delivery under the invention.

Additional illustrative information on these and other known viral-based delivery systems can be found, for example, in Fisher-Hoch et al., *Proc. Natl. Acad. Sci. USA* 86:317-321, 1989; Flexner et al., *Ann. N.Y. Acad. Sci.* 569: 86-103, 1989; Flexner et al., *Vaccine* 8:17-21, 1990; U.S. Pat. Nos. 4,603,112, 4,769,330, and 5,017,487; WO 89/01973; U.S. Pat. No. 4,777,127; GB 2,200,651; EP 0,345,242; WO 91/02805; Berkner, *Biotechniques* 6:616-627, 1988; Rosenfeld et al., *Science* 252:431-434, 1991; Kolls et al., *Proc. Natl. Acad. Sci. USA* 91:215-219, 1994; Kass-Eisler et al., *Proc. Natl. Acad. Sci. USA* 90:11498-11502, 1993; Guzman et al., *Circulation* 88:2838-2848, 1993; and Guzman et al., *Cir. Res.* 73:1202-1207, 1993.

In certain embodiments, a polynucleotide may be integrated into the genome of a target cell. This integration may be in the specific location and orientation via homologous recombination (gene replacement) or it may be integrated in a random, non-specific location (gene augmentation). In yet further embodiments, the polynucleotide may be stably maintained in the cell as a separate, episomal segment of DNA. Such polynucleotide segments or "episomes" encode sequences sufficient to permit maintenance and replication independent of or in synchronization with the host cell cycle. The manner in which the expression construct is delivered to a cell and where in the cell the polynucleotide remains is dependent on the type of expression construct employed.

In another embodiment of the invention, a polynucleotide is administered/delivered as "naked" DNA, for example as described in Ulmer et al., *Science* 259:1745-1749, 1993 and reviewed by Cohen, *Science* 259:1691-1692, 1993. The uptake of naked DNA may be increased by coating the DNA onto biodegradable beads, which are efficiently transported into the cells.

In still another embodiment, a composition of the present invention can be delivered via a particle bombardment approach, many of which have been described. In one illustrative example, gas-driven particle acceleration can be achieved with devices such as those manufactured by Powderject Pharmaceuticals PLC (Oxford, UK) and Powderject Vaccines Inc. (Madison, Wis.), some examples of which are described in U.S. Pat. Nos. 5,846,796; 6,010,478; 5,865,796; 5,584,807; and EP Patent No. 0500 799. This approach offers a needle-free delivery approach wherein a dry powder formulation of microscopic particles, such as polynucleotide or polypeptide particles, are accelerated to high speed within a helium gas jet generated by a hand held device, propelling the particles into a target tissue of interest.

In a related embodiment, other devices and methods that may be useful for gas-driven needle-less injection of compositions of the present invention include those provided by Bioject, Inc. (Portland, Oreg.), some examples of which are described in U.S. Pat. Nos. 4,790,824; 5,064,413; 5,312,335; 5,383,851; 5,399,163; 5,520,639 and 5,993,412.

According to another embodiment, the pharmaceutical compositions described herein will comprise one or more immunostimulants in addition to the immunogenic polynucleotide, polypeptide, antibody, T-cell and/or APC compositions of this invention. An immunostimulant refers to essentially any substance that enhances or potentiates an immune response (antibody and/or cell-mediated) to an exogenous antigen. One preferred type of immunostimulant comprises an adjuvant. Many adjuvants contain a substance designed to protect the antigen from rapid catabolism, such as aluminum hydroxide or mineral oil, and a stimulator of immune responses, such as lipid A, *Bortadella pertussis* or *Mycobacterium tuberculosis* derived proteins. Certain adjuvants are commercially available as, for example, Freund's Incomplete Adjuvant and Complete Adjuvant (Difco Laboratories, Detroit, Mich.); Merck Adjuvant 65 (Merck and Company, Inc., Rahway, N.J.); AS-2 (SmithKline Beecham, Philadelphia, Pa.); aluminum salts such as aluminum hydroxide gel (alum) or aluminum phosphate; salts of calcium, iron or zinc; an insoluble suspension of acylated tyrosine; acylated sugars; cationically or anionically derivatized polysaccharides; polyphosphazenes; biodegradable microspheres; monophosphoryl lipid A and quil A. Cytokines, such as GM-CSF, interleukin-2, -7, -12, and other like growth factors, may also be used as adjuvants.

Within certain embodiments of the invention, the adjuvant composition is preferably one that induces an immune response predominantly of the Th1 type. High levels of Th1-type cytokines (e.g., IFN-γ, TNFα, IL-2 and IL-12) tend to favor the induction of cell mediated immune responses to an administered antigen. In contrast, high levels of Th2-type cytokines (e.g., IL-4, IL-5, IL-6 and IL-10) tend to favor the induction of humoral immune responses. Following application of a vaccine as provided herein, a patient will support an immune response that includes Th1- and Th2-type responses. Within a preferred embodiment, in which a response is predominantly Th1-type, the level of Th1-type cytokines will increase to a greater extent than the level of Th2-type cytokines. The levels of these cytokines may be readily assessed using standard assays. For a review of the families of cytokines, see Mosmann and Coffman, *Ann. Rev. Immunol.* 7:145-173, 1989.

Certain preferred adjuvants for eliciting a predominantly Th1-type response include, for example, a combination of monophosphoryl lipid A, preferably 3-de-O-acylated monophosphoryl lipid A, together with an aluminum salt. MPL® adjuvants are available from Corixa Corporation (Seattle, Wash.; see, for example, U.S. Pat. Nos. 4,436,727; 4,877,611; 4,866,034 and 4,912,094). CpG-containing oligonucleotides (in which the CpG dinucleotide is unmethylated) also induce a predominantly Th1 response. Such oligonucleotides are well known and are described, for example, in WO 96/02555, WO 99/33488 and U.S. Pat. Nos. 6,008,200 and 5,856,462. Immunostimulatory DNA sequences are also described, for example, by Sato et al., *Science* 273:352, 1996. Another preferred adjuvant comprises a saponin, such as Quil A, or derivatives thereof, including QS21 and QS7 (Aquila Biopharmaceuticals Inc., Framingham, Mass.); Escin; Digitonin; or *Gypsophila* or *Chenopodium quinoa* saponins. Other preferred formulations include more than one saponin in the adjuvant combinations of the present invention, for example combinations of at least two of the following group comprising QS21, QS7, Quil A, β-escin, or digitonin.

Alternatively the saponin formulations may be combined with vaccine vehicles composed of chitosan or other polycationic polymers, polylactide and polylactide-co-glycolide particles, poly-N-acetyl glucosamine-based polymer matrix, particles composed of polysaccharides or chemically modified polysaccharides, liposomes and lipid-based particles, particles composed of glycerol monoesters, etc. The saponins may also be formulated in the presence of cholesterol to form particulate structures such as liposomes or ISCOMs. Furthermore, the saponins may be formulated together with a polyoxyethylene ether or ester, in either a non-particulate solution or suspension, or in a particulate structure such as a paucilamelar liposome or ISCOM. The saponins may also be formulated with excipients such as Carbopol® to increase viscosity, or may be formulated in a dry powder form with a powder excipient such as lactose.

In one preferred embodiment, the adjuvant system includes the combination of a monophosphoryl lipid A and a saponin derivative, such as the combination of QS21 and 3D-MPL® adjuvant, as described in WO 94/00153, or a less reactogenic composition where the QS21 is quenched with cholesterol, as described in WO 96/33739. Other preferred formulations comprise an oil-in-water emulsion and tocopherol. Another particularly preferred adjuvant formulation employing QS21, 3D-MPL® adjuvant and tocopherol in an oil-in-water emulsion is described in WO 95/17210.

Another enhanced adjuvant system involves the combination of a CpG-containing oligonucleotide and a saponin derivative particularly the combination of CpG and QS21 is disclosed in WO 00/09159. Preferably the formulation additionally comprises an oil in water emulsion and tocopherol.

Additional illustrative adjuvants for use in the pharmaceutical compositions of the invention include Montanide ISA 720 (Seppic, France), SAF (Chiron, Calif., United States), ISCOMS (CSL), MF-59 (Chiron), the SBAS series of adjuvants (e.g., SBAS-2 or SBAS-4, available from SmithKline Beecham, Rixensart, Belgium), Detox (Enhanzyn®) (Corixa, Hamilton, Mont.), RC-529 (Corixa, Hamilton, Mont.) and other aminoalkyl glucosaminide 4-phosphates (AGPs), such as those described in pending U.S. patent application Ser. Nos. 08/853,826 and 09/074,720, the disclosures of which are incorporated herein by reference in their entireties, and polyoxyethylene ether adjuvants such as those described in WO 99/52549A1.

Other preferred adjuvants include adjuvant molecules of the general formula $$HO(CH_2CH_2O)_n\text{-}A\text{-}R, \qquad (I)$$

wherein, n is 1-50, A is a bond or —C(O)—, R is $C_{1-50}$ alkyl or Phenyl $C_{1-50}$ alkyl.

One embodiment of the present invention consists of a vaccine formulation comprising a polyoxyethylene ether of general formula (I), wherein n is between 1 and 50, preferably 4-24, most preferably 9; the R component is $C_{1-50}$, preferably $C_4$-$C_{20}$ alkyl and most preferably $C_{12}$ alkyl, and A is a bond. The concentration of the polyoxyethylene ethers should be in the range 0.1-20%, preferably from 0.1-10%, and most preferably in the range 0.1-1%. Preferred polyoxyethylene ethers are selected from the following group: polyoxyethylene-9-lauryl ether, polyoxyethylene-9-steoryl ether, polyoxyethylene-8-steoryl ether, polyoxyethylene-4-lauryl ether, polyoxyethylene-35-lauryl ether, and polyoxyethylene-23-lauryl ether. Polyoxyethylene ethers such as polyoxyethylene lauryl ether are described in the Merck index ($12^{th}$ edition: entry 7717). These adjuvant molecules are described in WO 99/52549.

The polyoxyethylene ether according to the general formula (1) above may, if desired, be combined with another adjuvant. For example, a preferred adjuvant combination is preferably with CpG as described in the pending UK patent application GB 9820956.2.

According to another embodiment of this invention, an immunogenic composition described herein is delivered to a host via antigen presenting cells (APCs), such as dendritic cells, macrophages, B cells, monocytes and other cells that may be engineered to be efficient APCs. Such cells may, but need not, be genetically modified to increase the capacity for presenting the antigen, to improve activation and/or maintenance of the T cell response, to have anti-tumor effects per se and/or to be immunologically compatible with the receiver (i.e., matched HLA haplotype). APCs may generally be isolated from any of a variety of biological fluids and organs, including tumor and peritumoral tissues, and may be autologous, allogeneic, syngeneic or xenogeneic cells.

Certain preferred embodiments of the present invention use dendritic cells or progenitors thereof as antigen-presenting cells. Dendritic cells are highly potent APCs (Banchereau and Steinman, Nature 392:245-251, 1998) and have been shown to be effective as a physiological adjuvant for eliciting prophylactic or therapeutic antitumor immunity (see Timmerman and Levy, Ann. Rev. Med. 50:507-529, 1999). In general, dendritic cells may be identified based on their typical shape (stellate in situ, with marked cytoplasmic processes (dendrites) visible in vitro), their ability to take up, process and present antigens with high efficiency and their ability to activate naïve T cell responses. Dendritic cells may, of course, be engineered to express specific cell-surface receptors or ligands that are not commonly found on dendritic cells in vivo or ex vivo, and such modified dendritic cells are contemplated by the present invention. As an alternative to dendritic cells, secreted vesicles antigen-loaded dendritic cells (called exosomes) may be used within a vaccine (see Zitvogel et al., Nature Med. 4:594-600, 1998).

Dendritic cells and progenitors may be obtained from peripheral blood, bone marrow, tumor-infiltrating cells, peritumoral tissues-infiltrating cells, lymph nodes, spleen, skin, umbilical cord blood or any other suitable tissue or fluid. For example, dendritic cells may be differentiated ex vivo by adding a combination of cytokines such as GM-CSF, IL-4, IL-13 and/or TNFα to cultures of monocytes harvested from peripheral blood. Alternatively, CD34 positive cells harvested from peripheral blood, umbilical cord blood or bone marrow may be differentiated into dendritic cells by adding to the culture medium combinations of GM-CSF, IL-3, TNFα, CD40 ligand, LPS, flt3 ligand and/or other compound(s) that induce differentiation, maturation and proliferation of dendritic cells.

Dendritic cells are conveniently categorized as "immature" and "mature" cells, which allows a simple way to discriminate between two well characterized phenotypes. However, this nomenclature should not be construed to exclude all possible intermediate stages of differentiation. Immature dendritic cells are characterized as APC with a high capacity for antigen uptake and processing, which correlates with the high expression of Fcγ receptor and mannose receptor. The mature phenotype is typically characterized by a lower expression of these markers, but a high expression of cell surface molecules responsible for T cell activation such as class I and class II MHC, adhesion molecules (e.g., CD54 and CD11) and costimulatory molecules (e.g., CD40, CD80, CD86 and 4-1BB).

APCs may generally be transfected with a polynucleotide of the invention (or portion or other variant thereof) such that the encoded polypeptide, or an immunogenic portion thereof, is expressed on the cell surface. Such transfection may take place ex vivo, and a pharmaceutical composition comprising such transfected cells may then be used for therapeutic purposes, as described herein. Alternatively, a gene delivery vehicle that targets a dendritic or other antigen presenting cell may be administered to a patient, resulting in transfection that occurs in vivo. In vivo and ex vivo transfection of dendritic cells, for example, may generally be performed using any methods known in the art, such as those described in WO 97/24447, or the gene gun approach described by Mahvi et al., Immunology and cell Biology 75:456-460, 1997. Antigen loading of dendritic cells may be achieved by incubating dendritic cells or progenitor cells with the tumor polypeptide, DNA (naked or within a plasmid vector) or RNA; or with antigen-expressing recombinant bacterium or viruses (e.g., vaccinia, fowlpox, adenovirus or lentivirus vectors). Prior to loading, the polypeptide may be covalently conjugated to an immunological partner that provides T cell help (e.g., a carrier molecule). Alternatively, a dendritic cell may be pulsed with a non-conjugated immunological partner, separately or in the presence of the polypeptide.

While any suitable carrier known to those of ordinary skill in the art may be employed in the pharmaceutical compositions of this invention, the type of carrier will typically vary depending on the mode of administration. Compositions of the present invention may be formulated for any appropriate manner of administration, including for example, topical, oral, nasal, mucosal, intravenous, intracranial, intraperitoneal, subcutaneous and intramuscular administration.

Carriers for use within such pharmaceutical compositions are biocompatible, and may also be biodegradable. In certain embodiments, the formulation preferably provides a relatively constant level of active component release. In other embodiments, however, a more rapid rate of release immediately upon administration may be desired. The formulation of such compositions is well within the level of ordinary skill in the art using known techniques. Illustrative carriers useful in this regard include microparticles of poly(lactide-co-glycolide), polyacrylate, latex, starch, cellulose, dextran and the like. Other illustrative delayed-release carriers include supramolecular biovectors, which comprise a non-liquid hydrophilic core (e.g., a cross-linked polysaccharide or oligosaccharide) and, optionally, an external layer comprising an amphiphilic compound, such as a phospholipid (see e.g., U.S. Pat. No. 5,151,254 and PCT applications WO 94/20078, WO/94/23701 and WO 96/06638). The amount of active compound contained within a sustained release formulation depends upon the site of implantation, the rate and expected duration of release and the nature of the condition to be treated or prevented.

In another illustrative embodiment, biodegradable microspheres (e.g., polylactate polyglycolate) are employed as carriers for the compositions of this invention. Suitable biodegradable microspheres are disclosed, for example, in U.S. Pat. Nos. 4,897,268; 5,075,109; 5,928,647; 5,811,128; 5,820, 883; 5,853,763; 5,814,344, 5,407,609 and 5,942,252. Modified hepatitis B core protein carrier systems. such as described in WO/99 40934, and references cited therein, will also be useful for many applications. Another illustrative carrier/delivery system employs a carrier comprising particulate-protein complexes, such as those described in U.S. Pat. No. 5,928,647, which are capable of inducing a class 1-restricted cytotoxic T lymphocyte responses in a host.

The pharmaceutical compositions of the invention will often further comprise one or more buffers (e.g., neutral buffered saline or phosphate buffered saline), carbohydrates (e.g., glucose, mannose, sucrose or dextrans), mannitol, proteins, polypeptides or amino acids such as glycine, antioxidants, bacteriostats, chelating agents such as EDTA or glutathione, adjuvants (e.g., aluminum hydroxide), solutes that render the formulation isotonic, hypotonic or weakly hypertonic with the blood of a recipient, suspending agents, thickening agents and/or preservatives. Alternatively, compositions of the present invention may be formulated as a lyophilizate.

The pharmaceutical compositions described herein may be presented in unit-dose or multi-dose containers, such as sealed ampoules or vials. Such containers are typically sealed in such a way to preserve the sterility and stability of the formulation until use. In general, formulations may be stored as suspensions, solutions or emulsions in oily or aqueous vehicles. Alternatively, a pharmaceutical composition may be stored in a freeze-dried condition requiring only the addition of a sterile liquid carrier immediately prior to use.

The development of suitable dosing and treatment regimens for using the particular compositions described herein in a variety of treatment regimens, including e.g., oral, parenteral, intravenous, intranasal, and intramuscular administration and formulation, is well known in the art, some of which are briefly discussed below for general purposes of illustration.

In certain applications, the pharmaceutical compositions disclosed herein may be delivered via oral administration to an animal. As such, these compositions may be formulated with an inert diluent or with an assimilable edible carrier, or they may be enclosed in hard- or soft-shell gelatin capsule, or they may be compressed into tablets, or they may be incorporated directly with the food of the diet.

The active compounds may even be incorporated with excipients and used in the form of ingestible tablets, buccal tables, troches, capsules, elixirs, suspensions, syrups, wafers, and the like (see, for example, Mathiowitz et al., Nature 1997 Mar. 27;386(6623):410-4; Hwang et al., Crit Rev Ther Drug Carrier Syst 1998;15(3):243-84; U.S. Pat. No. 5,641,515; U.S. Pat. No. 5,580,579 and U.S. Pat. No. 5,792,451). Tablets, troches, pills, capsules and the like may also contain any of a variety of additional components, for example, a binder, such as gum tragacanth, acacia, cornstarch, or gelatin; excipients, such as dicalcium phosphate; a disintegrating agent, such as corn starch, potato starch, alginic acid and the like; a lubricant, such as magnesium stearate; and a sweetening agent, such as sucrose, lactose or saccharin may be added or a flavoring agent, such as peppermint, oil of wintergreen, or cherry flavoring. When the dosage unit form is a capsule, it may contain, in addition to materials of the above type, a liquid carrier. Various other materials may be present as coatings or to otherwise modify the physical form of the dosage unit. For instance, tablets, pills, or capsules may be coated with shellac, sugar, or both. Of course, any material used in preparing any dosage unit form should be pharmaceutically pure and substantially non-toxic in the amounts employed. In addition, the active compounds may be incorporated into sustained-release preparation and formulations.

Typically, these formulations will contain at least about 0.1% of the active compound or more, although the percentage of the active ingredient(s) may, of course, be varied and may conveniently be between about 1 or 2% and about 60% or 70% or more of the weight or volume of the total formulation. Naturally, the amount of active compound(s) in each therapeutically useful composition may be prepared is such a way that a suitable dosage will be obtained in any given unit dose of the compound. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

For oral administration the compositions of the present invention may alternatively be incorporated with one or more excipients in the form of a mouthwash, dentifrice, buccal tablet, oral spray, or sublingual orally-administered formulation. Alternatively, the active ingredient may be incorporated into an oral solution such as one containing sodium borate, glycerin and potassium bicarbonate, or dispersed in a dentifrice, or added in a therapeutically-effective amount to a composition that may include water, binders, abrasives, flavoring agents, foaming agents, and humectants. Alternatively the compositions may be fashioned into a tablet or solution form that may be placed under the tongue or otherwise dissolved in the mouth.

In certain circumstances it will be desirable to deliver the pharmaceutical compositions disclosed herein parenterally, intravenously, intramuscularly, or even intraperitoneally. Such approaches are well known to the skilled artisan, some of which are further described, for example, in U.S. Pat. No. 5,543,158; U.S. Pat. No. 5,641,515 and U.S. Pat. No. 5,399,363. In certain embodiments, solutions of the active compounds as free base or pharmacologically acceptable salts may be prepared in water suitably mixed with a surfactant, such as hydroxypropylcellulose. Dispersions may also be prepared in glycerol, liquid polyethylene glycols, and mixtures thereof and in oils. Under ordinary conditions of storage and use, these preparations generally will contain a preservative to prevent the growth of microorganisms.

Illustrative pharmaceutical forms suitable for injectable use include sterile aqueous solutions or dispersions and sterile powders for the extemporaneous preparation of sterile injectable solutions or dispersions (for example, see U.S. Pat. No. 5,466,468). In all cases the form must be sterile and must be fluid to the extent that easy syringability exists. It must be stable under the conditions of manufacture and storage and must be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and/or by the use of surfactants. The prevention of the action of microorganisms can be facilitated by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

In one embodiment, for parenteral administration in an aqueous solution, the solution should be suitably buffered if necessary and the liquid diluent first rendered isotonic with sufficient saline or glucose. These particular aqueous solutions are especially suitable for intravenous, intramuscular, subcutaneous and intraperitoneal administration. In this connection, a sterile aqueous medium that can be employed will be known to those of skill in the art in light of the present disclosure. For example, one dosage may be dissolved in 1 ml of isotonic NaCl solution and either added to 1000 ml of hypodermoclysis fluid or injected at the proposed site of infusion, (see for example, "Remington's Pharmaceutical Sciences" 15th Edition, pages 1035-1038 and 1570-1580). Some variation in dosage will necessarily occur depending on the condition of the subject being treated. Moreover, for human administration, preparations will of course preferably meet sterility, pyrogenicity, and the general safety and purity standards as required by FDA Office of Biologics standards.

In another embodiment of the invention, the compositions disclosed herein may be formulated in a neutral or salt form. Illustrative pharmaceutically-acceptable salts include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective.

The carriers can further comprise any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Except insofar as any conventional media or agent is incompatible with the active ingredient, its use in the therapeutic compositions is contemplated. Supplementary active ingredients can also be incorporated into the compositions. The phrase "pharmaceutically-acceptable" refers to molecular entities and compositions that do not produce an allergic or similar untoward reaction when administered to a human.

In certain embodiments, the pharmaceutical compositions may be delivered by intranasal sprays, inhalation, and/or other aerosol delivery vehicles. Methods for delivering genes, nucleic acids, and peptide compositions directly to the lungs via nasal aerosol sprays has been described, e.g., in U.S. Pat. No. 5,756,353 and U.S. Pat. No. 5,804,212. Likewise, the delivery of drugs using intranasal microparticle resins (Takenaga et al., J Controlled Release 1998 Mar. 2;52(1-2):81-7) and lysophosphatidyl-glycerol compounds (U.S. Pat. No. 5,725,871) are also well-known in the pharmaceutical arts. Likewise, illustrative transmucosal drug delivery in the form of a polytetrafluoroetheylene support matrix is described in U.S. Pat. No. 5,780,045.

In certain embodiments, liposomes, nanocapsules, microparticles, lipid particles, vesicles, and the like, are used for the introduction of the compositions of the present invention into suitable host cells/organisms. In particular, the compositions of the present invention may be formulated for delivery either encapsulated in a lipid particle, a liposome, a vesicle, a nanosphere, or a nanoparticle or the like. Alternatively, compositions of the present invention can be bound, either covalently or non-covalently, to the surface of such carrier vehicles.

The formation and use of liposome and liposome-like preparations as potential drug carriers is generally known to those of skill in the art (see for example, Lasic, Trends Biotechnol 1998 July;16(7):307-21; Takakura, Nippon Rinsho 1998 March;56(3):691-5; Chandran et al., Indian J Exp Biol. 1997 August;35(8):801-9; Margalit, Crit Rev Ther Drug Carrier Syst. 1995;12(2-3):233-61; U.S. Pat. No. 5,567,434; U.S. Pat. No. 5,552,157; U.S. Pat. No. 5,565,213; U.S. Pat. No. 5,738,868 and U.S. Pat. No. 5,795,587, each specifically incorporated herein by reference in its entirety).

Liposomes have been used successfully with a number of cell types that are normally difficult to transfect by other procedures, including T cell suspensions, primary hepatocyte cultures and PC 12 cells (Renneisen et al., J Biol. Chem. 1990 Sep. 25;265(27):16337-42; Muller et al., DNA Cell Biol. 1990 April;9(3):221-9). In addition, liposomes are free of the DNA length constraints that are typical of viral-based delivery systems. Liposomes have been used effectively to introduce genes, various drugs, radiotherapeutic agents, enzymes, viruses, transcription factors, allosteric effectors and the like, into a variety of cultured cell lines and animals. Furthermore, he use of liposomes does not appear to be associated with autoimmune responses or unacceptable toxicity after systemic delivery.

In certain embodiments, liposomes are formed from phospholipids that are dispersed in an aqueous medium and spontaneously form multilamellar concentric bilayer vesicles (also termed multilamellar vesicles (MLVs).

Alternatively, in other embodiments, the invention provides for pharmaceutically-acceptable nanocapsule formulations of the compositions of the present invention. Nanocapsules can generally entrap compounds in a stable and reproducible way (see, for example, Quintanar-Guerrero et al., Drug Dev Ind Pharm. 1998 December;24(12):1113-28). To avoid side effects due to intracellular polymeric overloading, such ultrafine particles (sized around 0.1 µm) may be designed using polymers able to be degraded in vivo. Such particles can be made as described, for example, by Couvreur et al., Crit Rev Ther Drug Carrier Syst. 1988;5(1):1-20; zur Muhlen et al., Eur J Pharm Biopharm. 1998 March;45(2):149-55; Zambaux et al. J Controlled Release. 1998 Jan. 2;50(1-3):31-40; and U.S. Pat. No. 5,145,684.

Cancer Therapeutic Methods

Immunologic approaches to cancer therapy are based on the recognition that cancer cells can often evade the body's defenses against aberrant or foreign cells and molecules, and that these defenses might be therapeutically stimulated to regain the lost ground, e.g. pgs. 623-648 in Klein, Immunology (Wiley-Interscience, New York, 1982). Numerous recent observations that various immune effectors can directly or indirectly inhibit growth of tumors has led to renewed interest in this approach to cancer therapy, e.g. Jager, et al., Oncology 2001;60(1):1-7; Renner, et al., Ann Hematol 2000 December; 79(12):651-9.

Four-basic cell types whose function has been associated with antitumor cell immunity and the elimination of tumor cells from the body are: i) B-lymphocytes which secrete immunoglobulins into the blood plasma for identifying and labeling the nonself invader cells; ii) monocytes which secrete the complement proteins that are responsible for lysing and processing the immunoglobulin-coated target invader cells; iii) natural killer lymphocytes having two mechanisms for the destruction of tumor cells, antibody-dependent cellular cytotoxicity and natural killing; and iv) T-lymphocytes possessing antigen-specific receptors and having the capacity to recognize a tumor cell carrying complementary marker molecules (Schreiber, H., 1989, in Fundamental Immunology (ed). W. E. Paul, pp. 923-955).

Cancer immunotherapy generally focuses on inducing humoral immune responses, cellular immune responses, or both. Moreover, it is well established that induction of CD4+ T helper cells is necessary in order to secondarily induce either antibodies or cytotoxic CD8+ T cells. Polypeptide antigens that are selective or ideally specific for cancer cells, particularly lung cancer cells, offer a powerful approach for inducing immune responses against lung cancer, and are an important aspect of the present invention.

Therefore, in further aspects of the present invention, the pharmaceutical compositions described herein may be used for the treatment of cancer, particularly for the immunotherapy of lung cancer. Within such methods, the pharmaceutical compositions described herein are administered to a patient, typically a warm-blooded animal, preferably a human. A patient may or may not be afflicted with cancer. Accordingly, the above pharmaceutical compositions may be used to prevent the development of a cancer or to treat a patient afflicted with a cancer. Pharmaceutical compositions and vaccines may be administered either prior to or following surgical removal of primary tumors and/or treatment such as administration of radiotherapy or conventional chemotherapeutic drugs. As discussed above, administration of the pharmaceutical compositions may be by any suitable method, including administration by intravenous, intraperitoneal, intramuscular, subcutaneous, intranasal, intradermal, anal, vaginal, topical and oral routes.

Within certain embodiments, immunotherapy may be active immunotherapy, in which treatment relies on the in vivo stimulation of the endogenous host immune system to react against tumors with the administration of immune response-modifying agents (such as polypeptides and polynucleotides as provided herein).

Within other embodiments, immunotherapy may be passive immunotherapy, in which treatment involves the delivery of agents with established tumor-immune reactivity (such as effector cells or antibodies) that can directly or indirectly mediate antitumor effects and does not necessarily depend on an intact host immune system. Examples of effector cells include T cells as discussed above, T lymphocytes (such as CD8+ cytotoxic T lymphocytes and CD4+ T-helper tumor-infiltrating lymphocytes), killer cells (such as Natural Killer cells and lymphokine-activated killer cells), B cells and antigen-presenting cells (such as dendritic cells and macrophages) expressing a polypeptide provided herein. T cell receptors and antibody receptors specific for the polypeptides recited herein may be cloned, expressed and transferred into other vectors or effector cells for adoptive immunotherapy. The polypeptides provided herein may also be used to generate antibodies or anti-idiotypic antibodies (as described above and in U.S. Pat. No. 4,918,164) for passive immunotherapy.

Monoclonal antibodies may be labeled with any of a variety of labels for desired selective usages in detection, diagnostic assays or therapeutic applications (as described in U.S. Pat. Nos. 6,090,365; 6,015,542; 5,843,398; 5,595,721; and 4,708,930, hereby incorporated by reference in their entirety as if each was incorporated individually). In each case, the binding of the labelled monoclonal antibody to the determinant site of the antigen will signal detection or delivery of a particular therapeutic agent to the antigenic determinant on the non-normal cell. A further object of this invention is to provide the specific monoclonal antibody suitably labelled for achieving such desired selective usages thereof.

Effector cells may generally be obtained in sufficient quantities for adoptive immunotherapy by growth in vitro, as described herein. Culture conditions for expanding single antigen-specific effector cells to several billion in number with retention of antigen recognition in vivo are well known in the art. Such in vitro culture conditions typically use intermittent stimulation with antigen, often in the presence of cytokines (such as IL-2) and non-dividing feeder cells. As noted above, immunoreactive polypeptides as provided herein may be used to rapidly expand antigen-specific T cell cultures in order to generate a sufficient number of cells for immunotherapy. In particular, antigen-presenting cells, such as dendritic, macrophage, monocyte, fibroblast and/or B cells, may be pulsed with immunoreactive polypeptides or transfected with one or more polynucleotides using standard techniques well known in the art. For example, antigen-presenting cells can be transfected with a polynucleotide having a promoter appropriate for increasing expression in a recombinant virus or other expression system. Cultured effector cells for use in therapy must be able to grow and distribute widely, and to survive long term in vivo. Studies have shown that cultured effector cells can be induced to grow in vivo and to survive long term in substantial numbers by repeated stimulation with antigen supplemented with IL-2 (see, for example, Cheever et al., *Immunological Reviews* 157:177, 1997).

Alternatively, a vector expressing a polypeptide recited herein may be introduced into antigen presenting cells taken from a patient and clonally propagated ex vivo for transplant back into the same patient. Transfected cells may be reintroduced into the patient using any means known in the art, preferably in sterile form by intravenous, intracavitary, intraperitoneal or intratumor administration.

Routes and frequency of administration of the therapeutic compositions described herein, as well as dosage, will vary from individual to individual, and may be readily established using standard techniques. In general, the pharmaceutical compositions and vaccines may be administered by injection (e.g., intracutaneous, intramuscular, intravenous or subcutaneous), intranasally (e.g., by aspiration) or orally. Preferably, between 1 and 10 doses may be administered over a 52 week period. Preferably, 6 doses are administered, at intervals of 1 month, and booster vaccinations may be given periodically thereafter. Alternate protocols may be appropriate for individual patients. A suitable dose is an amount of a compound that, when administered as described above, is capable of promoting an anti-tumor immune response, and is at least 10-50% above the basal (i.e., untreated) level. Such response can be monitored by measuring the anti-tumor antibodies in a patient or by vaccine-dependent generation of cytolytic effector cells capable of killing the patient's tumor cells in vitro. Such vaccines should also be capable of causing an immune response that leads to an improved clinical outcome (e.g., more frequent remissions, complete or partial or longer disease-free survival) in vaccinated patients as compared to non-vaccinated patients. In general, for pharmaceutical compositions and vaccines comprising one or more polypeptides, the amount of each polypeptide present in a dose ranges from about 25 μg to 5 mg per kg of host. Suitable dose sizes will vary with the size of the patient, but will typically range from about 0.1 mL to about 5 mL.

In general, an appropriate dosage and treatment regimen provides the active compound(s) in an amount sufficient to provide therapeutic and/or prophylactic benefit. Such a response can be monitored by establishing an improved clinical outcome (e.g., more frequent remissions, complete or partial, or longer disease-free survival) in treated patients as compared to non-treated patients. Increases in preexisting immune responses to a tumor protein generally correlate with an improved clinical outcome. Such immune responses may generally be evaluated using standard proliferation, cytotoxicity or cytokine assays, which may be performed using samples obtained from a patient before and after treatment.

Cancer Detection and Diagnostic Compositions, Methods and Kits

In general, a cancer may be detected in a patient based on the presence of one or more lung tumor proteins and/or polynucleotides encoding such proteins in a biological sample (for example, blood, sera, sputum urine and/or tumor biopsies) obtained from the patient. In other words, such proteins may be used as markers to indicate the presence or absence of a cancer such as lung cancer. In addition, such proteins may be useful for the detection of other cancers. The binding agents provided herein generally permit detection of the level of antigen that binds to the agent in the biological sample.

Polynucleotide primers and probes may be used to detect the level of mRNA encoding a tumor protein, which is also indicative of the presence or absence of a cancer. In general, a tumor sequence should be present at a level that is at least two-fold, preferably three-fold, and more preferably five-fold or higher in tumor tissue than in normal tissue of the same type from which the tumor arose. Expression levels of a particular tumor sequence in tissue types different from that in which the tumor arose are irrelevant in certain diagnostic embodiments since the presence of tumor cells can be confirmed by observation of predetermined differential expression levels, e.g., 2-fold, 5-fold, etc, in tumor tissue to expression levels in normal tissue of the same type.

Other differential expression patterns can be utilized advantageously for diagnostic purposes. For example, in one aspect of the invention, overexpression of a tumor sequence in tumor tissue and normal tissue of the same type, but not in other normal tissue types, e.g. PBMCs, can be exploited diagnostically. In this case, the presence of metastatic tumor cells, for example in a sample taken from the circulation or some other tissue site different from that in which the tumor arose, can be identified and/or confirmed by detecting expression of the tumor sequence in the sample, for example using RT-PCR analysis. In many instances, it will be desired to enrich for tumor cells in the sample of interest, e.g., PBMCs, using cell capture or other like techniques.

There are a variety of assay formats known to those of ordinary skill in the art for using a binding agent to detect polypeptide markers in a sample. See, e.g., Harlow and Lane, Antibodies: *A Laboratory Manual*, Cold Spring Harbor Laboratory, 1988. In general, the presence or absence of a cancer in a patient may be determined by (a) contacting a biological sample obtained from a patient with a binding agent; (b) detecting in the sample a level of polypeptide that binds to the binding agent; and (c) comparing the level of polypeptide with a predetermined cut-off value.

In a preferred embodiment, the assay involves the use of binding agent immobilized on a solid support to bind to and remove the polypeptide from the remainder of the sample. The bound polypeptide may then be detected using a detection reagent that contains a reporter group and specifically binds to the binding agent/polypeptide complex. Such detection reagents may comprise, for example, a binding agent that specifically binds to the polypeptide or an antibody or other agent that specifically binds to the binding agent, such as an anti-immunoglobulin, protein G, protein A or a lectin. Alternatively, a competitive assay may be utilized, in which a polypeptide is labeled with a reporter group and allowed to bind to the immobilized binding agent after incubation of the binding agent with the sample. The extent to which components of the sample inhibit the binding of the labeled polypeptide to the binding agent is indicative of the reactivity of the sample with the immobilized binding agent. Suitable polypeptides for use within such assays include full length lung tumor proteins and polypeptide portions thereof to which the binding agent binds, as described above.

The solid support may be any material known to those of ordinary skill in the art to which the tumor protein may be attached. For example, the solid support may be a test well in a microtiter plate or a nitrocellulose or other suitable membrane. Alternatively, the support may be a bead or disc, such as glass, fiberglass, latex or a plastic material such as polystyrene or polyvinylchloride. The support may also be a magnetic particle or a fiber optic sensor, such as those disclosed, for example, in U.S. Pat. No. 5,359,681. The binding agent may be immobilized on the solid support using a variety of techniques known to those of skill in the art, which are amply described in the patent and scientific literature. In the context of the present invention, the term "immobilization" refers to both noncovalent association, such as adsorption, and covalent attachment (which may be a direct linkage between the agent and functional groups on the support or may be a linkage by way of a cross-linking agent). Immobilization by adsorption to a well in a microtiter plate or to a membrane is preferred. In such cases, adsorption may be achieved by contacting the binding agent, in a suitable buffer, with the solid support for a suitable amount of time. The contact time varies with temperature, but is typically between about 1 hour and about 1 day. In general, contacting a well of a plastic microtiter plate (such as polystyrene or polyvinylchloride) with an amount of binding agent ranging from about 10 ng to about 10 µg, and preferably about 100 ng to about 1 µg, is sufficient to immobilize an adequate amount of binding agent.

Covalent attachment of binding agent to a solid support may generally be achieved by first reacting the support with a bifunctional reagent that will react with both the support and a functional group, such as a hydroxyl or amino group, on the binding agent. For example, the binding agent may be covalently attached to supports having an appropriate polymer coating using benzoquinone or by condensation of an aldehyde group on the support with an amine and an active hydrogen on the binding partner (see, e.g., Pierce Immunotechnology Catalog and Handbook, 1991, at A112-A13).

In certain embodiments, the assay is a two-antibody sandwich assay. This assay may be performed by first contacting an antibody that has been immobilized on a solid support, commonly the well of a microtiter plate, with the sample, such that polypeptides within the sample are allowed to bind to the immobilized antibody. Unbound sample is then removed from the immobilized polypeptide-antibody complexes and a detection reagent (preferably a second antibody capable of binding to a different site on the polypeptide) containing a reporter group is added. The amount of detection reagent that remains bound to the solid support is then determined using a method appropriate for the specific reporter group.

More specifically, once the antibody is immobilized on the support as described above, the remaining protein binding sites on the support are typically blocked. Any suitable blocking agent known to those of ordinary skill in the art, such as bovine serum albumin or Tween 20™ (Sigma Chemical Co., St. Louis, Mo.). The immobilized antibody is then incubated with the sample, and polypeptide is allowed to bind to the antibody. The sample may be diluted with a suitable diluent, such as phosphate-buffered saline (PBS) prior to incubation.

In general, an appropriate contact time (i.e., incubation time) is a period of time that is sufficient to detect the presence of polypeptide within a sample obtained from an individual with lung cancer. Preferably, the contact time is sufficient to achieve a level of binding that is at least about 95% of that achieved at equilibrium between bound and unbound polypeptide. Those of ordinary skill in the art will recognize that the time necessary to achieve equilibrium may be readily determined by assaying the level of binding that occurs over a period of time. At room temperature, an incubation time of about 30 minutes is generally sufficient.

Unbound sample may then be removed by washing the solid support with an appropriate buffer, such as PBS containing 0.1% Tween 20™. The second antibody, which contains a reporter group, may then be added to the solid support. Preferred reporter groups include those groups recited above.

The detection reagent is then incubated with the immobilized antibody-polypeptide complex for an amount of time sufficient to detect the bound polypeptide. An appropriate amount of time may generally be determined by assaying the level of binding that occurs over a period of time. Unbound detection reagent is then removed and bound detection reagent is detected using the reporter group. The method employed for detecting the reporter group depends upon the nature of the reporter group. For radioactive groups, scintillation counting or autoradiographic methods are generally appropriate. Spectroscopic methods may be used to detect dyes, luminescent groups and fluorescent groups. Biotin may be detected using avidin, coupled to a different reporter group (commonly a radioactive or fluorescent group or an enzyme). Enzyme reporter groups may generally be detected by the addition of substrate (generally for a specific period of time), followed by spectroscopic or other analysis of the reaction products.

To determine the presence or absence of a cancer, such as lung cancer, the signal detected from the reporter group that remains bound to the solid support is generally compared to a signal that corresponds to a predetermined cut-off value. In one preferred embodiment, the cut-off value for the detection of a cancer is the average mean signal obtained when the immobilized antibody is incubated with samples from patients without the cancer. In general, a sample generating a signal that is three standard deviations above the predetermined cut-off value is considered positive for the cancer. In an alternate preferred embodiment, the cut-off value is determined using a Receiver Operator Curve, according to the method of Sackett et al., *Clinical Epidemiology: A Basic Science for Clinical Medicine*, Little Brown and Co., 1985, p. 106-7. Briefly, in this embodiment, the cut-off value may be determined from a plot of pairs of true positive rates (i.e., sensitivity) and false positive rates (100%-specificity) that correspond to each possible cut-off value for the diagnostic test result. The cut-off value on the plot that is the closest to the upper left-hand corner (i.e., the value that encloses the largest area) is the most accurate cut-off value, and a sample generating a signal that is higher than the cut-off value determined by this method may be considered positive. Alternatively, the cut-off value may be shifted to the left along the plot, to minimize the false positive rate, or to the right, to minimize the false negative rate. In general, a sample generating a signal that is higher than the cut-off value determined by this method is considered positive for a cancer.

In a related embodiment, the assay is performed in a flow-through or strip test format, wherein the binding agent is immobilized on a membrane, such as nitrocellulose. In the flow-through test, polypeptides within the sample bind to the immobilized binding agent as the sample passes through the membrane. A second, labeled binding agent then binds to the binding agent-polypeptide complex as a solution containing the second binding agent flows through the membrane. The detection of bound second binding agent may then be performed as described above. In the strip test format, one end of the membrane to which binding agent is bound is immersed in a solution containing the sample. The sample migrates along the membrane through a region containing second binding agent and to the area of immobilized binding agent. Concentration of second binding agent at the area of immobilized antibody indicates the presence of a cancer. Typically, the concentration of second binding agent at that site generates a pattern, such as a line, that can be read visually. The absence of such a pattern indicates a negative result. In general, the amount of binding agent immobilized on the membrane is selected to generate a visually discernible pattern when the biological sample contains a level of polypeptide that would be sufficient to generate a positive signal in the two-antibody sandwich assay, in the format discussed above. Preferred binding agents for use in such assays are antibodies and antigen-binding fragments thereof. Preferably, the amount of antibody immobilized on the membrane ranges from about 25 ng to about 1 µg, and more preferably from about 50 ng to about 500 ng. Such tests can typically be performed with a very small amount of biological sample.

Of course, numerous other assay protocols exist that are suitable for use with the tumor proteins or binding agents of the present invention. The above descriptions are intended to be exemplary only. For example, it will be apparent to those of ordinary skill in the art that the above protocols may be readily modified to use tumor polypeptides to detect antibodies that bind to such polypeptides in a biological sample. The detection of such tumor protein specific antibodies may correlate with the presence of a cancer.

A cancer may also, or alternatively, be detected based on the presence of T cells that specifically react with a tumor protein in a biological sample. Within certain methods, a biological sample comprising $CD4^+$ and/or $CD8^+$ T cells isolated from a patient is incubated with a tumor polypeptide, a polynucleotide encoding such a polypeptide and/or an APC that expresses at least an immunogenic portion of such a polypeptide, and the presence or absence of specific activation of the T cells is detected. Suitable biological samples include, but are not limited to, isolated T cells. For example, T cells may be isolated from a patient by routine techniques (such as by Ficoll/Hypaque density gradient centrifugation of peripheral blood lymphocytes). T cells may be incubated in vitro for 2-9 days (typically 4 days) at 37° C. with polypeptide (e.g., 5-25 µg/ml). It may be desirable to incubate another aliquot of a T cell sample in the absence of tumor polypeptide to serve as a control. For $CD4^+$ T cells, activation is preferably detected by evaluating proliferation of the T cells. For $CD8^+$ T cells, activation is preferably detected by evaluating cytolytic activity. A level of proliferation that is at least two fold greater and/or a level of cytolytic activity that is at least 20% greater than in disease-free patients indicates the presence of a cancer in the patient.

As noted above, a cancer may also, or alternatively, be detected based on the level of mRNA encoding a tumor protein in a biological sample. For example, at least two oligonucleotide primers may be employed in a polymerase chain reaction (PCR) based assay to amplify a portion of a tumor cDNA derived from a biological sample, wherein at least one of the oligonucleotide primers is specific for (i.e., hybridizes to) a polynucleotide encoding the tumor protein. The amplified cDNA is then separated and detected using techniques well known in the art, such as gel electrophoresis.

Similarly, oligonucleotide probes that specifically hybridize to a polynucleotide encoding a tumor protein may be used in a hybridization assay to detect the presence of polynucleotide encoding the tumor protein in a biological sample.

To permit hybridization under assay conditions, oligonucleotide primers and probes should comprise an oligonucleotide sequence that has at least about 60%, preferably at least about 75% and more preferably at least about 90%, identity to a portion of a polynucleotide encoding a tumor protein of the invention that is at least 10 nucleotides, and preferably at least 20 nucleotides, in length. Preferably, oligonucleotide primers and/or probes hybridize to a polynucleotide encoding a polypeptide described herein under moderately stringent conditions, as defined above. Oligonucleotide primers and/or probes which may be usefully employed in the diagnostic methods described herein preferably are at least 10-40 nucleotides in length. In a preferred embodiment, the oligonucleotide primers comprise at least 10 contiguous nucleotides, more preferably at least 15 contiguous nucleotides, of a DNA molecule having a sequence as disclosed herein. Techniques for both PCR based assays and hybridization assays are well known in the art (see, for example, Mullis et al., *Cold Spring Harbor Symp. Quant. Biol.*, 51:263, 1987; Erlich ed., PCR Technology, Stockton Press, NY, 1989).

One preferred assay employs RT-PCR, in which PCR is applied in conjunction with reverse transcription. Typically, RNA is extracted from a biological sample, such as biopsy tissue, and is reverse transcribed to produce cDNA molecules. PCR amplification using at least one specific primer generates a cDNA molecule, which may be separated and visualized using, for example, gel electrophoresis. Amplification may be performed on biological samples taken from a test patient and from an individual who is not afflicted with a cancer. The amplification reaction may be performed on several dilutions of cDNA spanning two orders of magnitude. A two-fold or greater increase in expression in several dilutions of the test patient sample as compared to the same dilutions of the non-cancerous sample is typically considered positive.

In another aspect of the present invention, cell capture technologies may be used in conjunction, with, for example, real-time PCR to provide a more sensitive tool for detection of metastatic cells expressing lung tumor antigens. Detection of lung cancer cells in biological samples, e.g., bone marrow samples, peripheral blood, and small needle aspiration samples is desirable for diagnosis and prognosis in lung cancer patients.

Immunomagnetic beads coated with specific monoclonal antibodies to surface cell markers, or tetrameric antibody complexes, may be used to first enrich or positively select cancer cells in a sample. Various commercially available kits may be used, including Dynabeads® Epithelial Enrich (Dynal Biotech, Oslo, Norway), StemSep™ (StemCell Technologies, Inc., Vancouver, BC), and RosetteSep (StemCell Technologies). A skilled artisan will recognize that other methodologies and kits may also be used to enrich or positively select desired cell populations. Dynabeads® Epithelial Enrich contains magnetic beads coated with MAbs specific for two glycoprotein membrane antigens expressed on normal and neoplastic epithelial tissues. The coated beads may be added to a sample and the sample then applied to a magnet, thereby capturing the cells bound to the beads. The unwanted cells are washed away and the magnetically isolated cells eluted from the beads and used in further analyses.

RosetteSep can be used to enrich cells directly from a blood sample and consists of a cocktail of tetrameric antibodies that targets a variety of unwanted cells and crosslinks them to glycophorin A on red blood cells (RBC) present in the sample, forming rosettes. When centrifuged over Ficoll, targeted cells pellet along with the free RBC. The combination of antibodies in the depletion cocktail determines which cells will be removed and consequently which cells will be recovered. Antibodies that are available include, but are not limited to: CD2, CD3, CD4, CD5, CD8, CD10, CD11b, CD14, CD15, CD16, CD19, CD20, CD24, CD25, CD29, CD33, CD34, CD36, CD38, CD41, CD45, CD45RA, CD45RO, CD56, CD66B, CD66e, HLA-DR, IgE, and TCRαβ.

Additionally, it is contemplated in the present invention that MAbs specific for lung tumor antigens can be generated and used in a similar manner. For example, MAbs that bind to tumor-specific cell surface antigens may be conjugated to magnetic beads, or formulated in a tetrameric antibody complex, and used to enrich or positively select metastatic lung tumor cells from a sample. Once a sample is enriched or positively selected, cells may be lysed and RNA isolated. RNA may then be subjected to RT-PCR analysis using lung tumor-specific primers in a real-time PCR assay as described herein. One skilled in the art will recognize that enriched or selected populations of cells may be analyzed by other methods (e.g. in situ hybridization or flow cytometry).

In another embodiment, the compositions described herein may be used as markers for the progression of cancer. In this embodiment, assays as described above for the diagnosis of a cancer may be performed over time, and the change in the level of reactive polypeptide(s) or polynucleotide(s) evaluated. For example, the assays may be performed every 24-72 hours for a period of 6 months to 1 year, and thereafter performed as needed. In general, a cancer is progressing in those patients in whom the level of polypeptide or polynucleotide detected increases over time. In contrast, the cancer is not progressing when the level of reactive polypeptide or polynucleotide either remains constant or decreases with time.

Certain in vivo diagnostic assays may be performed directly on a tumor. One such assay involves contacting tumor cells with a binding agent. The bound binding agent may then be detected directly or indirectly via a reporter group. Such binding agents may also be used in histological applications. Alternatively, polynucleotide probes may be used within such applications.

As noted above, to improve sensitivity, multiple tumor protein markers may be assayed within a given sample. It will be apparent that binding agents specific for different proteins provided herein may be combined within a single assay. Further, multiple primers or probes may be used concurrently. The selection of tumor protein markers may be based on routine experiments to determine combinations that results in optimal sensitivity. In addition, or alternatively, assays for tumor proteins provided herein may be combined with assays for other known tumor antigens.

The present invention further provides kits for use within any of the above diagnostic methods. Such kits typically comprise two or more components necessary for performing a diagnostic assay. Components may be compounds, reagents, containers and/or equipment. For example, one container within a kit may contain a monoclonal antibody or fragment thereof that specifically binds to a tumor protein. Such antibodies or fragments may be provided attached to a support material, as described above. One or more additional containers may enclose elements, such as reagents or buffers, to be used in the assay. Such kits may also, or alternatively, contain a detection reagent as described above that contains a reporter group suitable for direct or indirect detection of antibody binding.

Alternatively, a kit may be designed to detect the level of mRNA encoding a tumor protein in a biological sample. Such kits generally comprise at least one oligonucleotide probe or primer, as described above, that hybridizes to a polynucleotide encoding a tumor protein. Such an oligonucleotide may be used, for example, within a PCR or hybridization assay. Additional components that may be present within such kits include a second oligonucleotide and/or a diagnostic reagent or container to facilitate the detection of a polynucleotide encoding a tumor protein.

The following Examples are offered by way of illustration and not by way of limitation.

EXAMPLE 1

Identification and Characterization of Lung Tumor cDNAs

This Example illustrates the identification of cDNA molecules encoding lung tumor proteins from substracted cDNA libraries. Subtraction techniques normalize differentially expressed cDNAs so that rare transcripts that are over-expressed in lung tumor tissue may be recovered. Expression profiles of the sequences identified from these subtacted libraries were then further analyzed by micrarray analysis. Sequences identified herein are overexpressed in lung tumor or lung tumor and normal lung tissue as compared to other normal tissues. Thus, the cDNAs described herein provide candidates to which therapeutic monoclonal antibodies (naked or conjugated to toxins or radioisotopes) may be targeted. In addition these candidates may also be targets for therapeutic vaccines and can be used as diagnostic markers for the detection and monitoring of lung cancer.

A. Isolation of cDNA Sequences from Lung Adenocarcinoma Libraries Using Conventional cDNA Library Subtraction A human lung adenocarcinoma cDNA expression library was constructed from poly A$^+$ RNA from patient tissues (# 40031486) using a Superscript Plasmid System for cDNA Synthesis and Plasmid Cloning kit (BRL Life Technologies, Gaithersburg, Md.) following the manufacturer's protocol. Specifically, lung carcinoma tissues were homogenized with polytron (Kinematica, Switzerland) and total RNA was extracted using Trizol reagent (BRL Life Technologies) as directed by the manufacturer. The poly A$^+$ RNA was then purified using an oligo dT cellulose column as described in Sambrook et al., *Molecular Cloning: A Laboratory Manual*, Cold Spring Harbor Laboratories, Cold Spring Harbor, N.Y., 1989. First-strand cDNA was synthesized using the NotI/Oligo-dT18 primer. Double-stranded cDNA was synthesized, ligated with BstXI/EcoRI adaptors (Invitrogen, San Diego, Calif.) and digested with NotI. Following size fractionation with cDNA size fractionation columns (BRL Life Technologies), the cDNA was ligated into the BstXI/NotI site of pcDNA3.1 (Invitrogen) and transformed into ElectroMax E. coli DH10B cells (BRL Life Technologies) by electroporation. A total of 3×10$^6$ independent colonies were generated.

Using the same procedure, a normal human cDNA expression library was prepared from a panel of normal tissue specimens, including lung, liver, pancreas, skin, kidney, brain and resting PBMC.

cDNA library subtraction was performed using the above lung adenocarcinoma and normal tissue cDNA libraries, as described by Hara et al. (*Blood*, 84:189-199, 1994) with some modifications. Specifically, a lung adenocarcinoma-specific subtracted cDNA library was generated as follows. The normal tissue cDNA library (80 µg) was digested with BamHI and XhoI, followed by a filling-in reaction with DNA polymerase Klenow fragment. After phenol-chloroform extraction and ethanol precipitation, the DNA was dissolved in 133 µl of H$_2$O, heat-denatured and mixed with 133 µl (133 µg) of Photoprobe biotin (Vector Laboratories, Burlingame, Calif.). As recommended by the manufacturer, the resulting mixture was irradiated with a 270 W sunlamp on ice for 20 minutes. Additional Photoprobe biotin (67 µl) was added and the biotinylation reaction was repeated. After extraction with butanol five times, the DNA was ethanol-precipitated and dissolved in 23 µl H$_2$O. The resulting DNA, plus other highly redundant cDNA clones that were frequently recovered in previous lung subtractions formed the driver DNA.

To form the tracer DNA, 10 µg lung adenocarcinoma cDNA library was digested with NotI and SpeI, phenol chloroform extracted and passed through Chroma spin-400 columns (Clontech, Palo Alto, Calif.). Typically, 5 µg of cDNA was recovered after the sizing column. Following ethanol precipitation, the tracer DNA was dissolved in 5 µl H$_2$O. Tracer DNA was mixed with 15 µl driver DNA and 20 µl of 2× hybridization buffer (1.5 M NaCl/10 mM EDTA/50 mM HEPES pH 7.5/0.2% sodium dodecyl sulfate), overlaid with mineral oil, and heat-denatured completely. The sample was immediately transferred into a 68° C. water bath and incubated for 20 hours (long hybridization [LH]). The reaction mixture was then subjected to a streptavidin treatment followed by phenol/chloroform extraction. This process was repeated three more times. Subtracted DNA was precipitated, dissolved in 12 µl H$_2$O, mixed with 8 µl driver DNA and 20 µl of 2× hybridization buffer, and subjected to a hybridization at 68° C. for 2 hours (short hybridization [SH]). After removal of biotinylated double-stranded DNA, subtracted cDNA was ligated into NotI/SpeI site of chloramphenicol resistant pBCSK$^+$ (Stratagene, La Jolla, Calif.) and transformed into ElectroMax E. coli DH10B cells by electroporation to generate a lung adenocarcinoma specific subtracted cDNA library, referred to as LAT-S1 Similarly, LAT-S2 was generated by including 23 genes that were over-expressed in the tracer as additional drivers.

A second human lung adenocarcinoma cDNA expression library was constructed using adenocarcinoma tissue from a second patient (# 86-66) and used to prepare a second lung adenocarcinoma-specific subtracted cDNA library (referred to as LAT2-S2), as described above, using the same panel of normal tissues and the additional genes over-expressed in LAT-S1.

A third human metastatic lung adenocarcinoma library was constructed from a pool of two lung pleural effusions with lung and gastric adenocarcinoma origins. The subtracted cDNA library, referred to as Mets-sub2, was generated as described above using the same panel of normal tissues. The Mets-sub3 subtracted library was constructed by including 51 additional genes as drivers. These 51 genes were recovered in Mets-sub2, representing over-expressed housekeeping genes in the testers.

A total of 16 cDNA fragments isolated from LAT-S1, 585 cDNA fragments isolated from LAT-S2, 568 cDNA clones from LAT2-S2, 15 cDNA clones from Mets-sub2 and 343 cDNA clones from Mets-sub3, described above, were colony PCR amplified and their mRNA expression levels in lung tumor, normal lung, and various other normal and tumor tissues were determined using microarray technology (Incyte, Palo Alto, Calif.). Briefly, the PCR amplification products were dotted onto slides in an array format, with each product occupying a unique location in the array. mRNA was extracted from the tissue sample to be tested, reverse transcribed, and fluorescent-labeled cDNA probes were generated. The microarrays were probed with the labeled cDNA probes, the slides scanned and fluorescence intensity was measured. This intensity correlates with the hybridization intensity. Seventy-three non-redundant cDNA clones, of which 42 were found to be unique, showed over-expression in lung tumors, with expression in normal tissues tested (lung, skin, lymph node, colon, liver, pancreas, breast, heart, bone marrow, large intestine, kidney, stomach, brain, small intestine, bladder and salivary gland) being either undetectable, or at significantly lower levels compared to lung adenocarcinoma tumors. These clones were further characterized by DNA sequencing with a Perkin Elmer/Applied Biosystems Division Automated Sequencer Model 373A and/or Model 377 (Foster City, Calif.).

The sequences were compared to known sequences in the gene bank using the EMBL GenBank databases (release 96). No significant homologies were found to the sequence provided in SEQ ID NO:67, with no apparent homology to previously identified expressed sequence tags (ESTs). The sequences of SEQ ID NO:60, 62, 65, 66, 69-71, 74, 76, 79, 80, 84, 86, 89-92, 95, 97 and 98 were found to show some homology to previously identified expressed sequence tags (ESTs). The cDNA sequences of SEQ ID NO:59, 61, 63, 64, 67, 68, 72, 73, 75, 77, 78, 81-83, 85, 87, 88, 93, 94, 96, 99 and 100 showed homology to previously identified genes. The full-length cDNA sequences for the clones of SEQ ID NO:96 and 100 are provided in SEQ ID NO:316 and 318, respectively. The amino acid sequences for the clones of SEQ ID NO: 59, 61, 63, 64, 68, 73, 82, 83, 94, 96 and 100 are provided in SEQ ID NO:331, 328, 329, 332, 327, 333, 330, 326, 325, 324 and 335, respectively. The amino acid sequence encoded by the sequence of SEQ ID NO:69 (referred to as L552S) is provided in SEQ ID NO:786.

Further studies led to the isolation of an extended cDNA sequence and the open reading frame for L552S (SEQ ID NO:790). The amino acid sequence encoded by the cDNA sequence of SEQ ID NO:790 is provided in SEQ ID NO:791. Subsequent studies led to the isolation of the full-length cDNA sequence of L552S (SEQ ID NO:808). The full-length cDNA of L552S has an open-reading frame of 480 base pairs (SEQ ID NO:790) and encodes a putative polypeptide of 160 amino acids (SEQ ID NO:809).

Initial database searches failed to detect any sequence homology with proteins in the database, suggesting that L552S encodes a novel protein of unknown function. Recently, a cancer-testis antigen, XAGE-1, was found to be over-expressed in Ewing's Sarcoma (Liu et al., 2000 Cancer Res. 60:4752-4755). The determined cDNA sequence of XAGE-1 is provided in SEQ ID NO:792 with the corresponding amino acid sequence being provided in SEQ ID NO:793. A sequence comparison of L552S and XAGE-1 reveals striking identities as well as differences. The majority of the C-terminal sequences are identical to each other. The polypeptides predicted from L552S and XAGE-1 have diverged N-terminal sequences. Hydrophilicity analysis of the L552S amino acids suggested a very hydrophilic protein with no transmembrane domains predicted. PSORT analysis of L552S revealed the same result. Since L552S is also localized in chromosome X, it is likely to be a new isoform of cancer testis antigen, XAGE-1. The genomic sequence analysis revealed that both genes localized in the same region of the X chromosome and both have four exons. The last three exons are identical for L552S and XAGE-1. However, the first exon for XAGE-1 is upstream of the first exon for L552S and this results in distinct 5' nucleotide and amino acid sequences for L552S and XAGE-1. Therefore, L552S and XAGE-1 are alternatively spliced isoforms.

The amino acid sequence of this N-terminal portion of L552S is provided in SEQ ID NO:1830 with the corresponding cDNA sequence being provided in SEQ ID NO:1826. The cDNA sequences provided in SEQ ID NO:1827-1829 represent bp 394-681 of SEQ ID NO:808, bp394-534 of SEQ ID NO:808 and bp 214-394 of SEQ ID NO:792, respectively, with the corresponding amino acid sequences being provided in SEQ ID NO:1831-1833, respectively.

Full-length cloning efforts on L552S also led to the isolation of three additional cDNA sequences (SEQ ID NO:810-812; referred to as clones 50989, 50990 and 50992, respectively) from a metastatic lung adenocarcinoma library. The sequence of SEQ ID NO:810 was found to show some homology to previously identified human DNA sequences. The sequence of SEQ ID NO:811 was found to show some homology to a previously identified DNA sequence. The sequence of SEQ ID NO:812 was found to show some homology to previously identified ESTs.

The gene of SEQ ID NO:84 (referred to as L551S) was determined by real-time RT-PCR analysis to be over-expressed in 2/9 primary adenocarcinomas and to be expressed at lower levels in 2/2 metastatic adenocarcinomas and 1/2 squamous cell carcinomas. No expression was observed in normal tissues, with the exception of very low expression in normal stomach. Further studies on L551S led to the isolation of the 5' and 3' cDNA consensus sequences provided in SEQ ID NO:801 and 802, respectively. The L551S 5' sequence was found to show some homology to the previously identified gene STY8 (cDNA sequence provided in SEQ ID NO:803; corresponding amino acid sequence provided in SEQ ID NO:805), which is a mitogen activated protein kinase phosphatase. However, no significant homologies were found to the 3' sequence of L551S. Subsequently, an extended cDNA sequence for L551S was isolated (SEQ ID NO:804). The corresponding amino acid sequence is provided in SEQ ID NO:806. Further studies led to the isolation of two independent full-length clones for L551S (referred to as 54298 and 54305). These two clones have five nucleotide differences compared to the STY8 DNA sequence. Two of these differences are single nucleotide polymorphisms which do not effect the encoded amino acid sequences. The other three nucleotide differences are consistent between the two L551S clones but lead to encoded amino acid sequences that are different from the STY8 protein sequence. The determined cDNA sequences for the L551S full-length clones 54305 and 54298 are provided in SEQ ID NO:825 and 826, respectively, with the amino acid sequence for L551S being provided in SEQ ID NO:827.

B. Isolation of cDNA Sequences from Lung Adenocarcinoma Libraries Using PCR-Based cDNA Library Subtraction cDNA clones from a subtracted library, containing cDNA from a pool of two human lung primary adenocarcinomas subtracted against a pool of nine normal human tissue cDNAs including skin, colon, lung, esophagus, brain, kidney, spleen, pancreas and liver, (Clontech, Palo Alto, Calif.) were submitted to a first round of PCR amplification. This library (referred to as ALT-1) was subjected to a second round of PCR amplification, following the manufacturer's protocol. The expression levels of 760 cDNA clones in lung tumor, normal lung, and various other normal and tumor tissues, were examined using microarray technology as described above. A total of 118 clones, of which 55 were unique, were found to be over-expressed in lung tumor tissue, with expression in normal tissues tested (lung, skin, lymph node, colon, liver, pancreas, breast, heart, bone marrow, large intestine, kidney, stomach, brain, small intestine, bladder and salivary gland) being either undetectable, or at significantly lower levels. The sequences were compared to known sequences in the gene bank using the EMBL and GenBank databases (release 96). No significant homologies (including ESTs) were found to the sequence provided in SEQ ID NO:44. The sequences of SEQ ID NO:1, 11, 13, 15, 20, 23-27, 29, 30, 33, 34, 39, 41, 43, 45, 46, 51 and 57 were found to show some homology to previously identified expressed sequence tags (ESTs). The cDNA sequences of SEQ ID NO:2-10, 12, 14, 16-19, 21, 22, 28, 31, 32, 35-38, 40, 42, 44, 47-50, 52-56 and 58 showed homology to previously identified genes. The full-length cDNA sequences for the clones of SEQ ID NO:18, 22, 31, 35, 36 and 42 are provided in SEQ ID NO:320, 319, 323, 321, 317, 321 and 322, respectively, with the corresponding amino acid sequences being provided in SEQ ID NO: 337, 336, 340, 338, 334, and 339, respectively.

Further studies led to the isolation of an extended cDNA sequence for the clone of SEQ ID NO:33 (referred to as L801P). This extended cDNA sequence (provided in SEQ ID NO:796), was found to contain three potential open reading frames (ORFs). The predicted amino acid sequences encoded by these three ORFs are provided in SEQ ID NO:797-799, respectively. Additional full-length cloning efforts led to still further extended cDNA sequence for L801P, set forth in SEQ ID NO:1669, in addition to five potential open reading frames (referred to as ORFs 4-9; SEQ ID NO:1670-1675, respectively) encoded by the extended cDNA sequence. L801P was mapped to chromosomal region 20p13 and a 137 amino acid ORF from this genomic region was identified that corresponds to ORF4 (SEQ ID NO:1670), suggesting that this is likely an authentic ORF for L801P.

By microarray analysis, L801P was found to be overexpressed by 2-fold or greater in lung tumor tissue compared to normal tissue. By real-time PCR analysis, greater than 50% of lung adenocarcinoma and greater than 30% of lung squamous cell carcinoma tumor samples tested had elevated L801P expression relative to normal lung tissue. Of those that displayed elevated L801P, the level of expression was greater than 10-fold higher than in normal lung tissue samples. Moreover, low or no expression of L801P was detected in an extensive panel of normal tissue RNAs.

L801P expression was also detected in a number of other tumor types, including breast, prostate, ovarian and colon tumors, and thus may have diagnostic and/or therapeutic utility in these cancer types.

In subsequent studies, a full-length cDNA sequence for the clone of SEQ ID NO:44 (referred to as L844P) was isolated (provided in SEQ ID NO:800). Comparison of this sequence with those in the public databases revealed that the 470 bases at the 5' end of the sequence show homology to the known gene dihydrodiol dehydrogenase, thus indicating that L844P is a novel transcript of the dihydrodiol dehydrogenase family having 2007 base pairs of previously unidentified 3' untranslated region.

The predicted amino acid sequence encoded by the sequence of SEQ ID NO:46 (referred to as L840P) is provided in SEQ ID NO:787. An extended cDNA sequence for L840P, which was determined to include an open reading frame, is provided in SEQ ID NO:794. The predicted amino acid sequence encoded by the cDNA sequence of SEQ ID NO:794 is provided in SEQ ID NO:795. The full-length cDNA sequence for the clone of SEQ ID NO:54 (referred to as L548S) is provided in SEQ ID NO:788, with the corresponding amino acid sequence being provided in SEQ ID NO:789.

Northern blot analyses of the genes of SEQ ID NO:25 and 46 (referred to as L839P and L840P, respectively) were remarkably similar. Both genes were expressed in 1/2 lung adenocarcinomas as two bands of 3.6 kb and 1.6 kb. No expression of L839P was observed in normal lung or trachea. No expression of L840P was observed in normal bone marrow, resting or activated PBMC, esophagus, or normal lung. Given the similar expression patterns, L839P and L840P may be derived from the same gene.

Additional lung adenocarcinoma cDNA clones were isolated as follows. A cDNA library was prepared from a pool of two lung adenocarcinomas and subtracted against cDNA from a panel of normal tissues including lung, brain, liver, kidney, pancreas, skin, heart and spleen. The subtraction was performed using a PCR-based protocol (Clontech), which was modified to generate larger fragments. Within this protocol, tester and driver double stranded cDNA were separately digested with five restriction enzymes that recognize six-nucleotide restriction sites (MluI, MscI, PvuII, SalI and StuI). This digestion resulted in an average cDNA size of 600 bp, rather than the average size of 300 bp that results from digestion with RsaI according to the Clontech protocol. The ends of the restriction digested tester cDNA were filled in to generate blunt ends for adapter ligation. This modification did not affect the subtraction efficiency. Two tester populations were then created with different adapters, and the driver library remained without adapters. The tester and driver libraries were then hybridized using excess driver cDNA. In the first hybridization step, driver was separately hybridized with each of the two tester cDNA populations. This resulted in populations of (a) unhybridized tester cDNAs, (b) tester cDNAs hybridized to other tester cDNAs, (c) tester cDNAs hybridized to driver cDNAs and (d) unhybridized driver cDNAs. The two separate hybridization reactions were then combined, and rehybridized in the presence of additional denatured driver cDNA. Following this second hybridization, in addition to populations (a) through (d), a fifth population (e) was generated in which tester cDNA with one adapter hybridized to tester cDNA with the second adapter. Accordingly, the second hybridization step resulted in enrichment of differentially expressed sequences which could be used as templates for PCR amplification with adaptor-specific primers.

The ends were then filled in, and PCR amplification was performed using adaptor-specific primers. Only population (e), which contained tester cDNA that did not hybridize to driver cDNA, was amplified exponentially. A second PCR amplification step was then performed, to reduce background and further enrich differentially expressed sequences.

Fifty-seven cDNA clones were isolated from the subtracted library (referred to as LAP1) and sequenced. The determined cDNA sequences for 16 of these clones are provided in SEQ ID NO:101-116. The sequences of SEQ ID NO:101 and 114 showed no significant homologies to previously identified sequences. The sequences of SEQ ID NO:102-109 and 112 showed some similarity to previously identified sequences, while the sequences of SEQ ID NO:113, 115 and 116 showed some similarity to previously isolated ESTs.

An additional 502 clones analyzed from the LAP1 library were sequenced and the determined cDNA sequences are shown in SEQ ID NO:828-1239 and 1564-1653.

C. Isolation of cDNA Sequences from Small Cell Lung Carcinoma Libraries Using PCR-Based cDNA Library Subtraction A subtracted cDNA library for small cell lung carcinoma (referred to as SCL1) was prepared essentially using the modified PCR-based subtraction process described above. cDNA from small cell lung carcinoma was subtracted against cDNA from a panel of normal tissues, including normal lung, brain, kidney, liver, pancreas, skin, heart, lymph node and spleen. Both tester and driver poly A+ RNA were initially amplified using SMART PCR cDNA synthesis kit (Clontech, Palo Alto, Calif.). The tester and driver double stranded cDNA were separately digested with five restriction enzymes (DraI, MscI, PvuII, SmaI, and StuI). These restriction enzymes generated blunt end cuts and the digestion resulted in an average insert size of 600 bp. Digestion with this set of restriction enzymes eliminates the step required to generate blunt ends by filling in of the cDNA ends. These modifications did not affect subtraction efficiency.

Eighty-five clones were isolated and sequenced. The determined cDNA sequences for 31 of these clones are provided in SEQ ID NO:117-147. The sequences of SEQ ID NO:122, 124, 126, 127, 130, 131, 133, 136, 139 and 147 showed no significant homologies to previously identified sequences. The sequences of SEQ ID NO:120, 129, 135, 137, 140, 142, 144 and 145 showed some similarity to previously identified gene sequences, while the sequences of SEQ ID NO:114, 118, 119, 121, 123, 125, 128, 132, 134, 138, 141, 143 and 147 showed some similarity to previously isolated ESTs.

In further studies, three additional cDNA libraries were generated from poly A+ RNA from a single small cell lung carcinoma sample subtracted against a pool of poly A+ RNA from nine normal tissues (lung, brain, kidney, liver, pancreas, skin, heart pituitary gland and spleen). For the first library (referred to as SCL2), the subtraction was carried out essentially as described above for the LAP1 library, with the exception that the tester and driver were digested with PvuII, StuI, MscI and DraI. The ratio of tester and driver cDNA used was as recommended by Clontech. For the second library (referred to as SCL3), subtraction was performed essentially as for SCL2 except that cDNA for highly redundant clones identified from the SCL2 library was included in the driver cDNA. Construction of the SCL4 library was performed essentially as described for the SCL3 library except that a higher ratio of driver to tester was employed.

Each library was characterized by DNA sequencing and database analyses. The determined cDNA sequence for 35 clones isolated from the SCL2 library are provided in SEQ ID NO:245-279, with the determined cDNA sequences for 21 clones isolated from the SCL3 library and for 15 clones isolated from the SCL4 library being provided in SEQ ID NO:280-300 and 301-315, respectively. The sequences of SEQ ID NO:246, 254, 261, 262, 304, 309 and 311 showed no significant homologies to previously identified sequences. The sequence of SEQ ID NO:245, 248, 255, 266, 270, 275, 280, 282, 283, 288-290, 292, 295, 301 and 303 showed some homology to previously isolated ESTs, while the sequences of SEQ ID NO:247, 249-253, 256-260, 263-265, 267-269, 271-274, 276-279, 281, 284-287, 291, 293, 294, 296-300, 302, 305-308, 310 and 312-315 showed some homology to previously identified gene sequences.

Sequences disclosed herein were firtjer evaluated for overexpression in specific tumor tissues by microarray analysis. Using this approach, cDNA sequences were PCR amplified and their mRNA expression profiles in tumor and normal tissues were examined using cDNA microarray technology essentially as described (Shena, M. et al., 1995 Science 270: 467-70). In brief, the clones were arrayed onto glass slides as multiple replicas, with each location corresponding to a unique cDNA clone (as many as 5500 clones can be arrayed on a single slide or chip). Each chip was hybridized with a pair of cDNA probes that are fluorescence-labeled with Cy3 and Cy5, respectively. Typically, 1 μg of polyA+ RNA was used to generate each cDNA probe. After hybridization, the chips were scanned and the fluorescence intensity recorded for both Cy3 and Cy5 channels. There were multiple built-in quality control steps. First, the probe quality was monitored using a panel of ubiquitously expressed genes. Secondly, the control plate also can include yeast DNA fragments of which complementary RNA may be spiked into the probe synthesis for measuring the quality of the probe and the sensitivity of the analysis. Currently, the technology offers a sensitivity of 1 in 100,000 copies of mRNA. Finally, the reproducibility of this technology can be ensured by including duplicated control cDNA elements at different locations.

3264 cDNA clones from three PCR-based subtracted cDNA libraries were analyzed by the above cDNA microarray technology. The cDNA clones were arrayed on Lung Chip 5. Of the these cDNA clones, 960 clones came from SQL1 library, 768 clones came from SCL1 library, and 1536 clones came from SCL3 and SCL4 libraries. Thirty-five pairs of fluorescent labeled cDNA probes were used for the microarray analysis. Each probe pair included a lung tumor probe paired with a normal tissue probe. The expression data was analyzed. 498 cDNA clones were found to be overexpressed by 2-fold or greater in the small cell and/or non-small cell lung tumor probe groups compared to the normal tissue probe group. Also, the mean expression values for these clones in normal tissues were below 0.1 (range of expression is from 0.001 to 10). The cDNA sequences disclosed in SEQ ID NO:1240-1563 represent 324 non-redundant clones.

The following sequences were novel based on database analysis including GenBank and GeneSeq: SEQ ID NO:1240, 1243, 1247, 1269, 1272, 1280, 1283, 1285, 1286, 1289, 1300, 1309, 1318, 1319, 1327, 1335, 1339, 1346, 1359, 1369, 1370, 1371, 1393, 1398, 1405, 1408, 1413, 1414, 1417, 1422, 1429, 1432, 1435, 1436, 1438-1442, 1447, 1450, 1453, 1463, 1467, 1470, 1473, 1475, 1482, 1486, 1491-1494, 1501, 1505, 1506, 1514-1517, 1520, 1522, 1524, 1535, 1538, 1542, 1543, 1547, 1554, 1557, 1559, 1561, and 1563.

The extended cDNA sequence of the partial sequence of contig 139 (SEQ ID NO:1467), also known as L985P, was predicted by searching public databases using SEQ ID NO:1467 as a query. By this approach, it was found that SEQ ID NO:1467 had homology to a cDNA sequence (SEQ ID NO:1676) which encodes the cell surface immunomodulator-2 (CSIMM-2). The cDNA sequence of SEQ ID NO:1676 encodes a protein having the sequence set forth in SEQ ID NO:1677.

By microarray analysis, L985P was overexpressed by 2-fold or greater in the lung tumor probe groups compared to the normal tissue probe group. Moreover, the mean expression values for L985P in normal tissues was below 0.2 (range of expression was from 0.01 to 10). By real-time PCR analysis, greater than 40% of small cell lung carcinoma lung tumor samples tested had elevated L985P expression relative to normal lung tissue. Of those that displayed elevated L985P, the level of expression was greater than 3-fold higher than in normal lung tissue samples. Low or no expression of L985P was detected in an extensive panel of normal tissue RNAs. These findings for L985P support its use both as a diagnositic marker for detecting the presence of lung cancer in a patient and/or as an immunotherapeutic target for the treatment of lung cancer.

D. Isolation of cDNA Sequences from a Neuroendocrine Library Using PCR-Based cDNA Library Subtraction Using the modified PCR-based subtraction process, essentially as described above for the LAP1 subtracted library, a subtracted cDNA library (referred to as MLN1) was derived from a lung neuroendocrine carcinoma that had metastasized to the subcarinal lymph node, by subtraction with a panel of nine normal tissues, including normal lung, brain, kidney, liver, pancreas, skin, heart, lymph node and spleen.

Ninety-one individual clones were isolated and sequenced. The determined cDNA sequences for 58 of these clones are provided in SEQ ID NO:147-222. The sequences of SEQ ID NO:150, 151, 154, 157, 158, 159, 160, 163, 174, 175, 178, 186-190, 192, 193, 195-200, 208-210, 212-215 and 220 showed no significant homologies to previously identified sequences. The sequences of SEQ ID NO:152, 155, 156, 161, 165, 166, 176, 179, 182, 184, 185, 191, 194, 221 and 222 showed some similarity to previously identified gene sequences, while the sequences of SEQ ID NO:148, 149, 153, 164, 167-173, 177, 180, 181, 183, 201-207, 211 and 216-219 showed some similarity to previously isolated ESTs.

The determined cDNA sequences of an additional 442 clones isolated from the MLN1 library are provided in SEQ ID NO:341-782, with the determined cDNA sequences of an additional 11 clones isolated from the MLN1 library are provided in SEQ ID NO:1654-1664.

E. Isolation of cDNA Sequences from a Squamous Cell Lung Carcinoma Library Using PCR-Based cDNA Library Subtraction A subtracted cDNA library for squamous cell lung carcinoma (referred to as SQL1) was prepared essentially using the modified PCR-based subtraction process described above, except the tester and driver double stranded cDNA were separately digested with four restriction enzymes (DraI, MscI, PvuII and StuI). cDNA from a pool of two squamous cell lung carcinomas was subtracted against cDNA from a pool of 10 normal tissues, including normal lung, brain, kidney, liver, pancreas, skin, heart, spleen, esophagus and trachea.

Seventy-four clones were isolated and sequenced. The determined cDNA sequences for 22 of these clones are provided in SEQ ID NO:223-244. The sequence of SEQ ID NO:241 showed no significant homologies to previously identified sequences. The sequences of SEQ ID NO:223, 225, 232, 233, 235, 238, 239, 242 and 243 showed some similarity to previously identified gene sequences, while the sequences of SEQ ID NO:224, 226-231, 234, 236, 237, 240, 241 and 244 showed some similarity to previously isolated ESTs.

The sequences of an additional 12 clones isolated during characterization of cDNA libraries prepared from lung tumor tissue are provided in SEQ ID NO:813-824. Comparison of these sequences with those in the GenBank database and the GeneSeq DNA database revealed no significant homologies to previously identified sequences.

EXAMPLE 2

Synthesis of Polypeptides

Polypeptides may be synthesized on a Perkin Elmer/Applied Biosystems Division 430A peptide synthesizer using FMOC chemistry with HPTU (O-Benzotriazole-N, N,N',N'-tetramethyluronium hexafluorophosphate) activation. A Gly-Cys-Gly sequence may be attached to the amino terminus of the peptide to provide a method of conjugation, binding to an immobilized surface, or labeling of the peptide. Cleavage of the peptides from the solid support may be carried out using the following cleavage mixture: trifluoroacetic acid: ethanedithiol:thioanisole:water:phenol (40:1:2:2:3). After cleaving for 2 hours, the peptides may be precipitated in cold methyl-t-butyl-ether. The peptide pellets may then be dissolved in water containing 0.1% trifluoroacetic acid (TFA) and lyophilized prior to purification by C18 reverse phase HPLC. A gradient of 0%-60% acetonitrile (containing 0.1% TFA) in water (containing 0.1% TFA) may be used to elute the peptides. Following lyophilization of the pure fractions, the peptides may be characterized using electrospray or other types of mass spectrometry and by amino acid analysis.

EXAMPLE 3

Expression In *E. Coli* of L548S His Tag Fusion Protein

The L548S coding region was PCR amplified with the following primers:

Forward primer starting at amino acid 2:

```
PDM-433:                          (SEQ ID NO:1665)
5' gctaaaggtgaccccaagaaaccaaag 3' Tm 60° C.
```

Reverse primer creating a XhoI site after the stop codon:

```
PDM-438:                          (SEQ ID NO:1666)
5' ctattaactcgagggagacagataaacagtttcttta 3'

Tm 61° C.
```

The PCR product was then digested with XhoI restriction enzyme, gel purified and then cloned into pPDM His, a modified pET28 vector with a His tag in frame, which had been digested with Eco72I and XhoI restriction enzymes. The correct construct was confirmed by DNA sequence analysis and then transformed into BL21 (DE3) pLys S and BL21 (DE3) CodonPlus RIL expression hosts. The protein sequence of expressed recombinant L548S is shown in SEQ ID NO:1667, and the DNA sequence of expressed recombinant L7548S is shown in SEQ ID NO:1668.

EXAMPLE 4

Additional Analyses of Lung Chip 5 SQL1, SCL1, SCL3 and SCL4 Libraries

This example describes the identification of additional cDNA cones that are over-expressed in lung carcinomas. The sequences identified herein have utility in immunotherapeutic and/or diagnostic applications.

Additional analyses were performed on lung chip 5 using a criteria of greater than or equal to 2-fold over-expression in tumor probe groups versus normal tissues and an average expression in normal tissues of less than or equal to 0.2. This resulted in the identification of 109 non-redundant clones that are over-expressed in lung carcinomas. As summarized in the Table 11 below, 19 cDNA clones were recovered from the lung squamous cell carcinoma subtracted library SQL1, 9 cDNA clones were recovered from the small cell lung carcinoma library SCL1, and 81 cDNA clones were recovered from the small cell lung carcinoma libraries SCL3 and SCL4.

TABLE 11

| SEQ ID NO: | Seq. Ref. | Element (384) | Element (96) | Ratio | Mean Signal 1 | Mean Signal 2 | Library |
|---|---|---|---|---|---|---|---|
| 1680 | 58456 | p0003r03c13 | R0001 E7 | 3.09 | 0.424 | 0.137 | SQL1 |
| 1681 | 58458 | p0003r03c10 | R0001 F5 | 2.31 | 0.408 | 0.176 | SQL1 |
| 1682 | 58462 | p0003r04c16 | R0001 H8 | 2.22 | 0.257 | 0.116 | SQL1 |
| 1683 | 58469 | p0003r07c12 | R0002 F6 | 2.1 | 0.289 | 0.138 | SQL1 |
| 1684 | 58470 | p0003r09c21 | R0003 A11 | 2.55 | 0.493 | 0.194 | SQL1 |
| 1685 | 58482 | p0003r12c19 | R0003 G10 | 2.16 | 0.36 | 0.167 | SQL1 |
| 1686 | 58485 | p0003r12c10 | R0003 H5 | 2.48 | 0.273 | 0.11 | SQL1 |
| 1687 | 58501 | p0004r04c23 | R0005 G12 | 2.04 | 0.26 | 0.128 | SQL1 |
| 1688 | 58502 | p0004r04c03 | R0005 G2 | 2.17 | 0.289 | 0.133 | SQL1 |
| 1689 | 58505 | p0004r05c23 | R0006 A12 | 3.08 | 0.454 | 0.148 | SQL1 |
| 1690 | 58507 | p0004r06c11 | R0006 C6 | 3.22 | 0.49 | 0.152 | SQL1 |
| 1691 | 58509 | p0004r07c15 | R0006 E8 | 3.26 | 0.421 | 0.129 | SQL1 |
| 1692 | 58512 | p0004r09c03 | R0007 A2 | 3.16 | 0.559 | 0.177 | SQL1 |
| 1693 | 58527 | p0004r12c22 | R0007 H11 | 2.03 | 0.278 | 0.137 | SQL1 |
| 1694 | 58529 | p0004r14c09 | R0008 C5 | 2.26 | 0.45 | 0.199 | SQL1 |
| 1695 | 58531 | p0004r16c01 | R0008 G1 | 2.84 | 0.387 | 0.136 | SQL1 |
| 1696 | 58537 | p0005r02c08 | R0009 D4 | 2.03 | 0.355 | 0.175 | SQL1 |
| 1697 | 58539 | p0005r03c08 | R0009 F4 | 2.34 | 0.42 | 0.18 | SQL1 |
| 1698 | 58545 | p0005r07c21 | R0010 E11 | 2.96 | 0.361 | 0.122 | SQL1 |
| 1699 | 59319 | p0005r10c04 | R0011 D2 | 3.1 | 0.478 | 0.154 | SCL1 |
| 1700 | 59322 | p0005r12c01 | R0011 G1 | 2.16 | 0.255 | 0.118 | SCL1 |
| 1701 | 59348 | p0006r11c12 | R0015 F6 | 2.33 | 0.269 | 0.116 | SCL1 |
| 1702 | 59350 | p0006r14c13 | R0016 C7 | 2.41 | 0.447 | 0.185 | SCL1 |
| 1703 | 59363 | p0007r02c16 | R0017 D8 | 2.12 | 0.421 | 0.199 | SCL1 |
| 1704 | 59365 | p0007r03c20 | R0017 F10 | 3.07 | 0.584 | 0.19 | SCL1 |
| 1705 | 59370 | p0007r04c10 | R0017 H5 | 2.06 | 0.284 | 0.138 | SCL1 |
| 1706 | 59373 | p0007r05c23 | R0018 A12 | 2.95 | 0.472 | 0.16 | SCL1 |
| 1707 | 59376 | p0007r06c02 | R0018 D1 | 2.13 | 0.246 | 0.116 | SCL1 |
| 1708 | 61050 | p0011r02c10 | R0033 D5 | 2.23 | 0.306 | 0.137 | SCL3/4 |
| 1709 | 61051 | p0011r03c23 | R0033 E12 | 2.9 | 0.298 | 0.103 | SCL3/4 |
| 1710 | 61052 | p0011r03c08 | R0033 F4 | 2.18 | 0.265 | 0.122 | SCL3/4 |
| 1711 | 61054 | p0011r03c16 | R0033 F8 | 2.11 | 0.415 | 0.197 | SCL3/4 |
| 1712 | 61056 | p0011r04c13 | R0033 G7 | 2.73 | 0.314 | 0.115 | SCL3/4 |
| 1713 | 61057 | p0011r04c10 | R0033 H5 | 2.45 | 0.463 | 0.189 | SCL3/4 |
| 1714 | 61060 | p0011r05c11 | R0034 A6 | 3.28 | 0.536 | 0.164 | SCL3/4 |
| 1715 | 61062 | p0011r06c21 | R0034 C11 | 2.73 | 0.526 | 0.192 | SCL3/4 |
| 1716 | 61063 | p0011r06c05 | R0034 C3 | 3.61 | 0.513 | 0.142 | SCL3/4 |
| 1717 | 61064 | p0011r06c04 | R0034 D2 | 2.58 | 0.477 | 0.185 | SCL3/4 |
| 1718 | 61065 | p0011r06c14 | R0034 D7 | 4.91 | 0.55 | 0.112 | SCL3/4 |
| 1719 | 61066 | p0011r06c18 | R0034 D9 | 2.38 | 0.285 | 0.12 | SCL3/4 |
| 1720 | 61069 | p0011r07c16 | R0034 F8 | 2.25 | 0.426 | 0.189 | SCL3/4 |
| 1721 | 61070 | p0011r08c21 | R0034 G11 | 2 | 0.234 | 0.117 | SCL3/4 |
| 1722 | 61071 | p0011r08c03 | R0034 G2 | 2.76 | 0.321 | 0.116 | SCL3/4 |
| 1723 | 61074 | p0011r08c16 | R0034 H8 | 3.02 | 0.399 | 0.132 | SCL3/4 |
| 1724 | 61075 | p0011r09c05 | R0035 A3 | 3.83 | 0.498 | 0.13 | SCL3/4 |
| 1725 | 61077 | p0011r10c21 | R0035 C11 | 2.12 | 0.306 | 0.144 | SCL3/4 |
| 1726 | 61079 | p0011r11c23 | R0035 E12 | 2.04 | 0.22 | 0.108 | SCL3/4 |
| 1727 | 61080 | p0011r11c15 | R0035 E8 | 2.76 | 0.299 | 0.108 | SCL3/4 |
| 1728 | 61081 | p0011r11c14 | R0035 F7 | 2.37 | 0.303 | 0.128 | SCL3/4 |
| 1729 | 61083 | p0011r12c15 | R0035 G8 | 2.29 | 0.351 | 0.153 | SCL3/4 |
| 1730 | 61085 | p0011r13c05 | R0036 A3 | 2.62 | 0.43 | 0.164 | SCL3/4 |
| 1731 | 61086 | p0011r13c09 | R0036 A5 | 2.53 | 0.398 | 0.157 | SCL3/4 |
| 1732 | 61088 | p0011r14c05 | R0036 C3 | 4.26 | 0.702 | 0.165 | SCL3/4 |
| 1733 | 61090 | p0011r15c07 | R0036 E4 | 3.16 | 0.429 | 0.136 | SCL3/4 |
| 1734 | 61091 | p0011r16c16 | R0036 H8 | 3.54 | 0.634 | 0.179 | SCL3/4 |
| 1735 | 61093 | p0012r02c03 | R0037 C2 | 2.2 | 0.265 | 0.121 | SCL3/4 |
| 1736 | 61094 | p0012r02c11 | R0037 C6 | 15.17 | 1.79 | 0.118 | SCL3/4 |
| 1737 | 61096 | p0012r02c08 | R0037 D4 | 2.44 | 0.27 | 0.111 | SCL3/4 |
| 1738 | 61097 | p0012r02c10 | R0037 D5 | 4.52 | 0.81 | 0.179 | SCL3/4 |
| 1739 | 61099 | p0012r03c02 | R0037 F1 | 3.34 | 0.39 | 0.117 | SCL3/4 |
| 1740 | 61100 | p0012r03c06 | R0037 F3 | 2.03 | 0.233 | 0.114 | SCL3/4 |
| 1741 | 61103 | p0012r04c17 | R0037 G9 | 2.48 | 0.413 | 0.167 | SCL3/4 |
| 1742 | 61105 | p0012r05c11 | R0038 A6 | 3.26 | 0.501 | 0.154 | SCL3/4 |
| 1743 | 61106 | p0012r05c08 | R0038 B4 | 2.46 | 0.354 | 0.144 | SCL3/4 |
| 1744 | 61110 | p0012r06c15 | R0038 C8 | 2.18 | 0.41 | 0.188 | SCL3/4 |
| 1745 | 61113 | p0012r07c09 | R0038 E5 | 2.47 | 0.376 | 0.152 | SCL3/4 |
| 1746 | 61115 | p0012r07c13 | R0038 E7 | 2.57 | 0.483 | 0.188 | SCL3/4 |
| 1747 | 61117 | p0012r07c24 | R0038 F12 | 2.18 | 0.235 | 0.108 | SCL3/4 |
| 1748 | 61118 | p0012r07c18 | R0038 F9 | 4.44 | 0.605 | 0.136 | SCL3/4 |
| 1749 | 61119 | p0012r08c03 | R0038 G2 | 2.97 | 0.35 | 0.118 | SCL3/4 |
| 1750 | 61120 | p0012r08c07 | R0038 G4 | 2.23 | 0.323 | 0.144 | SCL3/4 |
| 1751 | 61122 | p0012r08c18 | R0038 H9 | 2.23 | 0.373 | 0.168 | SCL3/4 |
| 1752 | 61125 | p0012r10c17 | R0039 C9 | 2.1 | 0.22 | 0.105 | SCL3/4 |
| 1753 | 61126 | p0012r10c16 | R0039 D8 | 2.47 | 0.345 | 0.14 | SCL3/4 |
| 1754 | 61130 | p0012r12c12 | R0039 H6 | 2.66 | 0.282 | 0.106 | SCL3/4 |
| 1755 | 61133 | p0012r13c24 | R0040 B12 | 2.25 | 0.27 | 0.12 | SCL3/4 |

TABLE 11-continued

| SEQ ID NO: | Seq. Ref. | Element (384) | Element (96) | Ratio | Mean Signal 1 | Mean Signal 2 | Library |
|---|---|---|---|---|---|---|---|
| 1756 | 61134 | p0012r14c23 | R0040 C12 | 2.23 | 0.228 | 0.102 | SCL3/4 |
| 1757 | 61135 | p0012r14c03 | R0040 C2 | 2.05 | 0.298 | 0.146 | SCL3/4 |
| 1758 | 61137 | p0012r14c02 | R0040 D1 | 8.63 | 1.463 | 0.17 | SCL3/4 |
| 1759 | 61139 | p0012r14c14 | R0040 D7 | 2.69 | 0.3 | 0.111 | SCL3/4 |
| 1760 | 61143 | p0012r16c02 | R0040 H1 | 2.55 | 0.318 | 0.125 | SCL3/4 |
| 1761 | 61144 | p0012r16c18 | R0040 H9 | 2.85 | 0.318 | 0.112 | SCL3/4 |
| 1762 | 61148 | p0013r02c19 | R0041 C10 | 2.33 | 0.463 | 0.199 | SCL3/4 |
| 1763 | 61151 | p0013r02c03 | R0041 C2 | 2.25 | 0.336 | 0.149 | SCL3/4 |
| 1764 | 61155 | p0013r04c07 | R0041 G4 | 2.13 | 0.366 | 0.171 | SCL3/4 |
| 1765 | 61156 | p0013r05c05 | R0042 A3 | 2.73 | 0.38 | 0.139 | SCL3/4 |
| 1766 | 61159 | p0013r06c24 | R0042 D12 | 4.57 | 0.831 | 0.182 | SCL3/4 |
| 1767 | 61160 | p0013r07c19 | R0042 E10 | 8.6 | 1.191 | 0.138 | SCL3/4 |
| 1768 | 61163 | p0013r07c18 | R0042 F9 | 2.18 | 0.278 | 0.128 | SCL3/4 |
| 1769 | 61167 | p0013r10c12 | R0043 D6 | 3.13 | 0.39 | 0.124 | SCL3/4 |
| 1770 | 61172 | p0013r12c03 | R0043 G2 | 2 | 0.396 | 0.198 | SCL3/4 |
| 1771 | 61173 | p0013r12c07 | R0043 G4 | 3.73 | 0.72 | 0.193 | SCL3/4 |
| 1772 | 61176 | p0013r13c04 | R0044 B2 | 2.34 | 0.446 | 0.19 | SCL3/4 |
| 1773 | 61177 | p0013r14c01 | R0044 C1 | 3.9 | 0.539 | 0.138 | SCL3/4 |
| 1774 | 61183 | p0013r15c14 | R0044 F7 | 5.49 | 0.959 | 0.175 | SCL3/4 |
| 1775 | 61185 | p0013r16c24 | R0044 H12 | 2.25 | 0.409 | 0.182 | SCL3/4 |
| 1776 | 61188 | p0014r01c07 | R0045 A4 | 2.14 | 0.271 | 0.127 | SCL3/4 |
| 1777 | 61192 | p0014r02c19 | R0045 C10 | 2.33 | 0.321 | 0.138 | SCL3/4 |
| 1778 | 61198 | p0014r04c24 | R0045 H12 | 2.3 | 0.321 | 0.14 | SCL3/4 |
| 1779 | 61201 | p0014r06c22 | R0046 D11 | 2.43 | 0.269 | 0.111 | SCL3/4 |
| 1780 | 61202 | p0014r06c08 | R0046 D4 | 2.57 | 0.346 | 0.135 | SCL3/4 |
| 1781 | 61204 | p0014r07c07 | R0046 E4 | 4.27 | 0.516 | 0.121 | SCL3/4 |
| 1782 | 61206 | p0014r07c12 | R0046 F6 | 2.18 | 0.364 | 0.167 | SCL3/4 |
| 1783 | 61210 | p0015r09c02 | R0051 B1 | 2.43 | 0.463 | 0.19 | SCL3/4 |
| 1784 | 61212 | p0015r10c15 | R0051 C8 | 2.64 | 0.406 | 0.154 | SCL3/4 |
| 1785 | 61216 | p0015r11c16 | R0051 F8 | 2.28 | 0.278 | 0.122 | SCL3/4 |
| 1786 | 61225 | p0015r14c12 | R0052 D6 | 2.25 | 0.25 | 0.111 | SCL3/4 |
| 1787 | 61226 | p0015r14c14 | R0052 D7 | 2.54 | 0.3 | 0.118 | SCL3/4 |
| 1788 | 61227 | p0015r16c18 | R0052 H9 | 2.06 | 0.312 | 0.151 | SCL3/4 |

The ratio of signal 1 to signal 2 in the table above provides a measure of the level of expression of the identified sequences in tumor versus normal tissues. For example, for SEQ ID NO:1669, the tumor-specific signal was 3.09 times that of the signal for the normal tissues tested; for SEQ ID NO:1670, the tumor-specific signal was 2.31 times that of the signal for normal tissues, etc.

EXAMPLE 5

Real-Time PCR Analyses of Lung Tumor Sequences

Real-time PCR was performed on a subset of the lung tumor sequences disclosed herein in order to further evaluate their expression profiles in various tumor and normal tissues. Briefly, quantitation of PCR product relies on the few cycles where the amount of DNA amplifies logarithmically from barely above the background to the plateau. Using continuous fluorescence monitoring, the threshold cycle number where DNA amplifies logarithmically is easily determined in each PCR reaction. There are two fluorescence detecting systems. One is based upon a double-strand DNA specific binding dye SYBR Green I dye. The other uses TaqMan probe containing a Reporter dye at the 5' end (FAM) and a Quencher dye at the 3' end (TAMRA) (Perkin Elmer/Applied Biosystems Division, Foster City, Calif.). Target-specific PCR amplification results in cleavage and release of the Reporter dye from the Quencher-containing probe by the nuclease activity of AmpliTaq Gold™ (Perkin Elmer/Applied Biosystems Division, Foster City, Calif.). Thus, fluorescence signal generated from released reporter dye is proportional to the amount of PCR product. Both detection methods have been found to generate comparable results. To compare the relative level of gene expression in multiple tissue samples, a panel of cDNAs is constructed using RNA from tissues and/or cell lines, and real-time PCR is performed using gene specific primers to quantify the copy number in each cDNA sample. Each cDNA sample is generally performed in duplicate and each reaction repeated in duplicated plates. The final Real-time PCR result is typically reported as an average of copy number of a gene of interest normalized against internal actin number in each cDNA sample. Real-time PCR reactions may be performed on a GeneAmp 5700 Detector using SYBR Green I dye or an ABI PRISM 7700 Detector using the TaqMan probe (Perkin Elmer/Applied Biosystems Division, Foster City, Calif.).

Results obtained from real-time PCR analysis of a number of lung tumor-specific sequences disclosed herein are summarized in the table below. In addition, extended cDNA sequences for many of these clones were obtained by searching public sequence databases. The extended sequences, and the proteins encoded by those sequences, are identified by SEQ ID NO: in Table 12 below.

TABLE 12

| Library | Clone Name | Clone No. | SEQ ID NO: | Real-Time PCR Results | Extended cDNA Sequence | Encoded Polypeptide Sequence |
|---|---|---|---|---|---|---|
| SQL1 | L972P | 47988 | 1789 | Overexpressed in 1/7 lung squamous tumor, 1/3 HN squamous tumor. Low or no expression in normal tissues. | | |
| SQL1 | L979P | 48005 | 1790 | Over-expressed in 2/7 squamous lung tumors, 1/3 HN squamous tumors, 1/2 adeno lung tumors. Low or no expression in normal tissues. | 1791 | 1806 |
| SQL1 | L970P | 49853 | 1269 | Highly overexpressed in 1/7 lung squamous tumors and 1/3 HN squamous tumor. Low or no expression in normal tissues. | | |
| SQL1 | L981P | 49865 | 1272 | Over-expressed in 1/6 squamous lung and 1/3 HN squamous tumors. Low or no expression in normal tissues. | | |
| SQL1 | L980P | 49826 | 1279 | Over-expressed in 3/7 squamous lung tumors, 1/3 HN squamous tumors, 1/2 adeno lung tumors. Low or no expression in normal tissues. | 1792 | 1807 |
| SCL1 | L973P | 20631 | 117 | Over-expressed in atypical carcinoid METs and adenocarcinoma. Expression in several normal tissues. | 1793 | 1808 |
| SCL1 | L974P | 20661 | 128 | Over-expressed in primary small cell, squamous and adenocarcinomas. Expression observed in several normal tissues. | 1794 | 1809 |
| SCL1 | L996P | 50430 | 1442 | Over-expressed in 2/2 Primary Small Cell, 6/6 Small Cell Cell Lines, 1/1 Atypical Carc. METs, 1/1 Adeno, 1/1 Squamous. Very low or no expression in normal tissues. | 1795 | 1810 |
| SCL3 | L977P | 26961 | 288 | Over-expressed in 1/2 Primary Small Cell, 1/6 Small Cell-Cell Line, and 1/1 Carcinoid Mets. Very low or no expression in normal tissues. | 1796 | 1811 |
| SCL2 | L978P | 24928 | 1339 | Over-expressed in 2/2 primary small cell, 3/6 small cell-cell lines, 1/1 carcinoid mets., adeno and squamous tumor pools; Low or no expression in normal tissues. | 1797 | 1812 |
| SCL3/4 | L984P | 50507 | 1446 | Highly expressed in 1/2 primary small cell tumors and 4/6 small cell tumor cell lines. Low or no expression in normal tissues. | 1798 | 1813 |
| SCL3/4 | L580S | 50536 | 1449 | Over-expressed in select small cell and squamous tumors. Some expression observed normal brain, bronchiol, soft palate and trachea. | | |
| SCL3/4 | L988P | 50645 | 1531 | Over-expressed in 1/2 Primary Small Cell, 1/2 Primary Small Cell, 6/6 Small Cell-Cell Lines, 1/1 Carcinoid Mets., Adeno & Squamous Tumor pool. Expressed in some normal tissues (brain, adrenal gland, salivary gland, trachea, thymus). | 1799 | 1814 |
| SCL3/4 | L1423P | 50625 | 1533 | Over-expressed in 1/2 primary small cell, 5/6 small cell-cell lines, 1/1 carcinoid mets. Also expressed in normal brain and pituitary gland. | 1800 | 1815 |
| SCL3/4 | L986P | 50483 | 1490 | Over-expressed in 1/2 primary small cell, 5/6 small cell-cell lines, 1/1 carcinoid mets., adeno and squamous tumor pool. Expressed in normal brain, pituitary gland and spinal cord. | | |
| SCL3/4 | L987P | 50560 | 1527 | Over-expression in 1/2 Primary Small Cell, 6/6 Small Cell-Cell Lines, 1/1 Carcinoid Mets. Expression in normal pituitary and adrenal glands. | 1801 | 1816-1818 |
| SCL3/4 | L1424P | 50639 | 1547 | Over-expression in 1/2 Primary Small Cell and 1/1 Carcinoid Mets. Low or no expression in normal tissues. | | |
| MLN1 | L997P | 26749 | 730 | Over-expression in 1/1 atypical carcinoid METs. No expression in normal tissues. | | |
| MLN1 | L999P | 26752 | 733 | Over-expressed in 2/2 Primary Small Cell, 6/6 Small Cell Cell Lines, 1/1 | | |

TABLE 12-continued

| Library | Clone Name | Clone No. | SEQ ID NO: | Real-Time PCR Results | Extended cDNA Sequence | Encoded Polypeptide Sequence |
|---|---|---|---|---|---|---|
| MLN1 | L1400P | 26529 | 405 | Atypical Carc. METs. Expression in several normal tissues. Over-expressed in 2/6 Small Cell Cell Lines and 2/2 Primary Small Cell. Moderate to low expression in several normal tissues. | | |
| MLN1 | L998P | 27699 | 468 | Over-expression in 1/1 Atypical Carcinoid METs. Low expression in normal tissues. | 1802 | 1819 |
| LAP1 | L1425P | 59303 | 949 | Over-expressed in 4/7 squamous tumors, 1/2 adenocarcinoma tumors and in a pool of six small cell lung carcinomas. Moderate to high expression observed in normal brain, kidney and skeletal muscle. | 1803 | 1820 |
| LAP1 | L1426P | 59314 | 1156 | Highly overexpressed in one lung squamous tumor and one HN squamous tumor. Very low or no expression observed in normal tissues. | 1804 | 1821 |
| LAP1 | L1427P | 59298 | 921 | Highly over-expressed in 3/12 adenocarcinoma tumors. Very low or no expression in normal tissues. | 1805 | 1822 |
| LAP1 | L1428P | 59316 | 1180 | Over-expressed in 4/12 adenocarcinoma tumors and lower level expression in several other adenocarcinoma tumors. Very low or no expression in normal tissues. | | |

EXAMPLE 6

Identification of CD4 Immunogenic T Cell Epitopes Derived from Lung Tumor Antigens This example describes the identification of specific epitopes recognized by L548S antigen-specific T cells. These experiments demonstrate the immunogenicity of the L548S protein and support its use as a target for vaccine and/or other immunotherapeutic approaches. Further, the above experiments identify specific epitopes of the L548S protein that may be of particular importance in the deveolpment of such approaches.

CD4 T cell lines specific for the antigen L548S (SEQ ID NO:789) were generated as follows.

A series of overlapping 20-mer peptides were synthesized that spanned the entire L548S sequence (SEQ ID NO:1834-1856, respectively). For priming, peptides were combined into pools of 4-5 peptides and cultured at 2 micrograms/ml with dendritic cells and purified CD4+ T cells in 96 well U-bottomed plates. One hundred cultures were generated for each peptide pool. Cultures were restimulated weekly with fresh dendritic cells loaded with peptide pools. Following a total of 3 stimulation cycles, cells were rested for an additional week and tested for specificity to antigen presenting cells (APC) pulsed with peptide pools using interferon-gamma ELISA and proliferation assays. For these assays, adherent monocytes loaded with either the relevant peptide pool, recombinant L548S or an irrelevant peptide were used as antigen presenting cells (APC). As shown in Table 13, below, a number of CD4 T cell lines demonstrated reactivity with the priming peptides as well as recombinant L548S protein. These lines were further expanded to be tested for recognition of individual peptides from the pools, as well as for recognition of recombinant L548S.

The dominant reactivity of these lines appeared to be with peptide 21 (SEQ ID NO:1854), which corresponds to amino acids 161-180 of L548S.

Thus, the above experiments demonstrate the immunogenicity of the L548S protein and further, identify specific epitopes of the L548S protein that may be of particular importance in the deveolpment of vaccine and/or other immunotherapeutic approaches.

TABLE 13

| | Stimulation Positive | Proliferation (CPM) | | | Stimulation Index | |
|---|---|---|---|---|---|---|
| Peptides | cell lines | No antigen | Peptides | L548S | Peptides | L548S |
| p1-5 | B1 | 700 | 14891 | 8791 | 21 | 13 |
| | B2 | 1135 | 48724 | 53944 | 42 | 47 |
| | G2 | 1227 | 7609 | 3193 | 6 | 3 |
| p6-10 | | | | | | |
| p11-15 | E2 | 8315 | 33723 | 13391 | 4 | 2 |
| | E4 | 22097 | 100040 | 44171 | 5 | 2 |
| p16-19 | | | | | | |
| p20-23 | E3 | 3937 | 45367 | 15524 | 11 | 4 |
| | F4 | 2648 | 130947 | 12927 | 49 | 5 |

EXAMPLE 7

Detection of Antibodies Against Lung Tumor Antigens in Patient Sera

This example identifies the presence of L548S antibodies in lung cancer patients. The data described herein show that L548S is immunogenic and support its use to generate therapeutic B cell immune responses in vivo.

Antibodies specific for the lung tumor antigens L548S (SEQ ID NO:789), and L552S (SEQ ID NO:809) were shown to be present in effusion fluid or sera of lung cancer patients but not in normal donors. More specifically, the presence of antibodies against L548S, L551S (SEQ ID NO:827) and L552S in effusion fluid obtained from lung cancer patients and in sera from normal donors was examined by ELISA using recombinant proteins and HRP-conjugated anti-human Ig. Briefly, each protein (100 ng) was coated in a 96-well plate at pH 9.5. In parallel, BSA (bovine serum albumin) was also coated as a control protein. The signals ([S], absorbance measured at 405 mm) against BSA ([N]) were determined. The results of these studies are shown in Table 14, wherein – represents [S]/[N]<2; +/– represents [S]/[N]>2; ++ represents [S]/[N]>3; and +++ represents [S]/[N]>5.

TABLE 14

Detection of Antibodies against Lung Tumor Antigens

|  | L548S | L551S | L552S |
|---|---|---|---|
| Effusion fluid |  |  |  |
| #1 | +/– | – | – |
| #2 | – | – | – |
| #3 | – | – | +++ |
| #4 | – | – | – |
| #5 | +/– | – | – |
| #7 | – | – | – |
| #8 | – | – | +/– |
| #10 | – | – | +/– |
| #11 | – | – | – |
| #12 | = | – | +/– |
| #13 | – | – | – |
| #14 | +/– | – | +/– |
| #15 | – | – | – |
| #17 | – | – | ++ |
| #18 | – | – | – |
| #19 | – | – | ++ |
| #20 | – | – | – |
| Normal sera |  |  |  |
| #21 | – | – | – |
| #22 | – | – | – |
| #23 | – | – | – |
| #24 | – | – | – |
| #25 | – | – | – |

Using Western blot analyses, antibodies against L552S were found to present in 1 out of 4 samples of effusion fluid from lung cancer patients, with no L552S antibodies being detected in the three samples of normal sera tested.

EXAMPLE 8

Fusion Proteins of Lung Tumor Antigens

Fusion proteins of full-length Ra12 with either L801P ORF4 (SEQ ID NO:1670) or L801P ORF5 (SEQ ID NO:1671) were prepared and expressed as single recombinant proteins in *E. coli* as follows.

The cDNA for ORF4 of L801P was obtained by PCR with a cDNA for the full length L801P and the primers of SEQ ID NO:1857 and 1858. The cDNA for ORF5 of L801P was obtained by PCR with a cDNA for the full length L801P and the primers of SEQ ID NO:1859 and 1860. The PCR products with expected size were recovered from agarose gel, digested with restriction enzymes EcoRI and XhoI, and cloned into the corresponding sites in the expression vector pCRX1 for subsequent expression in *E. coli*. For the fusion of Ra12 with ORF4, the best expression was obtained in HMS174(DE3) pLysS in 2xYS media, with recombinant protein being induced using IPTG at 37° C. for approximately 3 hours. For the fusion of Ra12 with ORF5, the best expression was obtained in HMS174(DE3)pLysS in 2xYS media, again with recombinant protein being induced using IPTG at 37° C. for approximately 3 hours. The plasmids used for the fusion protein production were confirmed by DNA sequencing. The determined cDNA sequences for the ORF4 and ORF5 fusions are provided in SEQ ID NO:1861 and 1862, respectively, with the corresponding amino acid sequences being provided in SEQ ID NO:1863 and 1864, respectively.

EXAMPLE 9

Cloning of cDNA Encoding Full-Length L984P

The example illustrates the isolation of cDNA sequences encoding L984P by PCR amplication from four separate cDNA sources. Briefly, an earlier isolated cDNA sequence of clone L984P was identified as having homology to a DNA sequence that encodes human achaete-scute homolog 1 (ASH1). Gene specific primers were made using the sequence information present in the public domain for ASH1 (genbank acc. NM-004316). Using these gene specific primers in PCR amplification, L984P was cloned from four separate cDNA sources. The four cDNA sources were a small cell lung carcinoma primary tumor sample (RNA Id. 573A), a METs neuroendocrine atypical carcinoid sample (RNA Id. 512A), and two small cell lung carcinoma cell lines (cell-line Id. NCI H128 and DMS79). The determined cDNA sequences for these four clones are provided in SEQ ID NO:1865-1868, respectively. The coding region of the cDNA contains a repeat of the triplet CAG that exhibits polymorphism in the human genomic DNA. This polymorphism can be observed in L984P cloned from the four different sources as well as from the cDNA of ASH1 and that derived from the human chromosome 4. The cDNA of ASH1 (genbank Acc. NM-006688) deposited in the genbank database contains 14 copies of the triple CAG, whereas the cDNA sequence derived from the human chromosome 4 sequence (genbank Acc. XM_006688) contains 12 copies of the triplet. The cDNA cloned from 573A and 512A both contain 12 copies of the CAG triplet. The cDNA cloned from the small cell lung carcinoma cell line DMS79 contains 13 copies of the triplet CAG, while the cDNA cloned from the small cell lung carcinoma cell line NCI H128 contains only 10 copies of the triplet CAG. As the polymorphism is present in the coding region, this results in polymorphisms in the protein sequences as well (see, SEQ ID NO:1869-1872).

EXAMPLE 10

Cloning OF cDNA Encoding Full-Length L985P

As previously disclosed in Example 1C, a search of the public databases using the sequence for contig 139 (SEQ ID NO:1467, also known as L985P) as the query was conducted and showed that this sequence had homology to the cDNA (SEQ ID NO:1676) encoding the cell surface immunomodulator-2 (CSIMM-2, sequence obtained from the Geneseq database). The full-length sequence of the clone was obtained by screening a small cell lung carcinoma cDNA library with a radioactively labeled probe of the original cloned sequence (SEQ ID NO:1467). Approximately 500,000 clones from the cDNA library were screened and 2 independent clones containing cDNA insert of 1.35 kb were isolated. The full-length cDNA sequence is provided in SEQ ID NO:1873 and the encoded amino acid sequence is provided in SEQ ID NO:1874. Surprisingly, an alignment of the isolated full-length cDNA sequence of L985P (SEQ ID NO:1873) with the Geneseq database sequence for CSIMM-2 showed that L985P differs from the GeneSeq database sequence by one nucleotide. This nucleotide difference results in a change of one amino acid residue at position 119 (G to E) of SEQ ID NO:1874.

The predicted protein structure and sequence of L985P indicates that it is a member of the recently described MS4A (membrane-spanning 4-domain, subfamily A) gene family (Liang and Tedder, 2001 Genomics 72:119-127). The MS4A gene family currently consists of at least 21 distinct human and mouse proteins of which nine members are from humans. These include CD20, FcεRIβ, HTm4, MS4A4A, MS4A5, MS4A6A, MS4A7, MS4A8B (same as L985P) and MS4A12. The MS4A family members are cell surface expressed proteins containing four transmembrane spanning domains, with N- and C-terminal regions facing the cytoplasmic side of the cells. The human MS4A family members exhibit 20-40% overall homology at the protein level, which is confined mostly to the transmembrane domains. The transmembrane domains of L985P share the highest homology to CD20 with approximately 40% identity and 60% similarity between the two protein sequences in this region. The MS4A family members demonstrate a broad tissue distribution with expression observed in diverse cell types in hematopoetic and nonhematopoetic tissues. However, expression of some MS4A family members is highly restricted to a particular cell type, such as CD20, which is only expressed on B-cells. As also mentioned in Example 1C, L985P (MS4A8B) is overexpressed in small cell lung carcinoma (SCLC) as determined by quantitative real-time PCR. Low level expression is seen in some normal tissues including lung, pituitary gland, stomach, colon, and trachea, while expression in other normal tissues checked was negligible or undetectable (see, Example 1C).

The physiological function for most of the MS4A family members remains to be elucidated. Previous studies have shown that CD20 is functionally important for the regulation of cell growth and differentiation, and signal transduction in B-cells. There is also evidence that CD20 may serve as a calcium channel by forming a homo- or heterotetrameric complex. FcεRIβ is part of a tetrameric receptor complex, which mediates interaction with IgE-bound antigens that lead to cellular responses such as the degranulation of mast cells. Because of the sequence and structural homologies between the MS4A family members, it is highly likely that they will share overlapping functional properties.

Some of the MS4A family members have been found to be associated with cancer. CD20 is expressed in more than 90% of B-cell non-Hodgkin lymphomas, which has made it an ideal target for immunotherapeutic approaches for the treatment of B-cell malignancies. Anti-CD20 monoclonal antibodies have been used with high success in the treatment of non-Hodgkin-lymphomas in both naïve and radiolabeled forms. The anti-CD20 MAbs have been shown to exert their antitumor effects through several pathways, which include complement-mediated cytolysis, antibody-mediated cellular cytotoxicity and antibody-mediated cell cycle arrest and apoptosis. Analysis of the human EST databases indicates that other members of the MS4A gene family including MS4A4A, A6A, A7 and A8B are also expressed in various cancers including lung, breast, pancreas, colon, ovary, kidney and brain. By comparison to CD20, one or more of the MS4A family genes would be used as targets for immunotherapeutic approaches for the treatment of hematopoetic and nonhematopoetic malignancies.

The MS4A protein family members are structurally similar to other membrane protein families with four transmembrane domains. These include the Tetraspanin protein family (TM4SF) and the GABA-A receptor protein family. Tetraspanins are associated with cancer and may play a direct role in controlling tumor progression. Although CD9 expression will positively influence B cell migration, CD9 overexpression suppresses motility and metastasis in carcinoma cells and there is an inverse correlation with metastasis in melanoma. However, CD9 is also expressed on 90% of non-T cell acute lymphoblastic leukemia cells and 50% of chronic lymphocytic leukemias. A recent study using RT-PCR analysis of tetraspanin expression in Burkitt lymphoma cell lines found that 90% of the lines express CD53, CD81, CD63, CD82 and SAS at high levels. CD151/PETA3 is an effector of metastasis and cell migration and MAbs that block this activity have been developed. Similarly, overexpression of the tetraspanin CO-029/D6.1 will increase the metastatic potential of cell lines. The tetraspanins control a diverse set of biological functions that can be regulated by MAbs. The functions of the tetraspanins, in general, can be grouped into actions that affect cell activation and proliferation, as well as adhesion and motility. These functions tend to be carried out by their association with integrins. The functional activity of tetraspanins can be modulated with MAbs in such a way as to control cell proliferation. For example, CD81/TAPA-1 is associated with B cell activation and increased proliferation, an activity that can be blocked with MAbs. MAbs with antiproliferative activity have been generated to the tetraspanin family member CO-029/D6.1.

As mentioned above, L985P is specifically over-expressed in small cell lung carcinomas. This fact and a comparison to CD20, tetraspanins and Her2 whose over-expression in cancers makes them effective cancer therapeutic targets, indicate that L985P may be a good target for immunotherapeutic approaches for the treatment of small cell lung carcinomas.

To facilitate the generation, purification, and evaluation of MAb against L985P, MAbs against the entire deduced amino acid sequence of the L985P protein, peptides derived from L985P or chemically produced (synthetic) L985P peptides will be used. Also, one can use MAbs raised against chimeric forms of L985P protein molecule fused to Ra12 protein, either the long form (Ra12—which is the first 128 amino acids of Ra12) and/or the short form (Ra12S), or fused to a polyhistidine peptide or any combination of these molecules. Provided are the predicted cDNA and amino acid sequences for the his-tagged L985P-Ra12 fusion molecules: Ra12-L985P_cDNA (SEQ ID NO:1875), Ra12-L985P_Protein (SEQ ID NO:1876), Ra12S-L985P_cDNA (SEQ ID NO:1877) and Ra12S-L985P_Protein (SEQ ID NO:1878); and the L985P derived peptides: his-tagged Ra12S-L985PEx_cDNA (SEQ ID NO:1879), his-tagged Ra12S-L985PEx_Protein (SEQ ID NO:1880), L985P_Extracellular_Loop-2_cDNA (SEQ ID NO:1881) and L985P_Extracellular_Loop-2_Peptide (SEQ ID NO:1882).

EXAMPLE 11

Expression in *E. Coli* of a His-Tagged RA12-L985P Fusion Protein

This example sets forth a specific embodiment of a fusion between Ra12 and L985P and its expression in *E. coli*. A his-tagged fusion protein of the long-form of Ra12 and all but the first three amino acid residues of L985P was expressed as a single recombinant protein in *E. coli*. The long-form of Ra12 was modified from the original sequence of amino acid residues 192-323 of MTA32A in that a putative thrombin cleavage site was replaced with a HindIII restriction site. The L985P was fused downstream of the Ra12 sequence in a pCRX1 vector. The Ra12 sequence was cloned downstream of the RBS. As a result, a his-tagged fusion protein is produced when the recombinant vector is expressed in *E. coli*. The sequence for the fusion of the long-form of Ra12 and L985P was confirmed by DNA sequencing. The determined cDNA sequence is provided in SEQ ID NO:1875 as this sequence is the same as that predicted in Example 10.

EXAMPLE 12

Cloning of cDNA Encoding Full-Length L1428P

As previously disclosed in Example 5, real-time PCR was performed on a subset of the lung tumor sequences disclosed herein in order to further evaluate their expression profiles in various tumor and normal tissues. The results are provided above in Table 12. One of the sequences analyzed was from clone #59316 (SEQ ID NO:1180, L1428P) and was shown to be expressed in a subset of lung adenocarcinomas.

Further studies have isolated the full-length cDNA for the cloned sequence of #59316 (SEQ ID NO:1180, L1428P). In order to determine the transcript size of the gene, a multiple tissue Northern blot was probed with the radioactively labeled original cloned sequence (SEQ ID NO:1180). The Northern blot included about 20 ug of total RNA from lung adenocarcinoma and normal tissues samples. Visual analysis of the exposed film revealed a single transcript of approximately 6.5-7.0 kb. The full-length sequence of the clone was obtained by screening a lung adenocarcinoma primary tumor cDNA library with a radioactively labeled probe of the original cloned sequence (SEQ ID NO:1180). Approximately 500,000 clones from the cDNA library were screened and 5 independent clones containing a cDNA insert of 6.8 kb were isolated. This insert size is similar to the size estimated by Northern-blot analysis. The full-length sequence is provided in SEQ ID NO:1883. Although no distinct ORF could be identified, seven potential ORFs can be predicted and the amino acid sequences of these potential ORFs, designated L1428P_ORF1 to ORF7, are provided in SEQ ID NO:1884-1890, respectively. The expression of full-length L1428P was re-analyzed by real-time PCR as set forth in Example 5 on extended cDNA panels for both lung adenocarcinomas and squamous cell carcinomas. The lung adenocarcinoma extended panel real-time results again confirm the expression of L1428P in adenocarcinoma with about 40-50% of the adenocarcinoma samples showing varying levels of expression. The real-time results from the squamous cell carcinoma extended panel shows that L1428P is also expressed in lung squamous cell carcinoma. However, the expression was in fewer lung squamous cell carcinoma samples and at a lower level.

EXAMPLE 13

Real-Time PCR Analysis of cDNA Sequences which are Over-Expressed In Lung Tumors as Shown by Microarray The following clones listed in Table 15 were shown previously to be over-expressed in lung tumors by microarray analysis (see, Example 2C and Example 6, Table 11). The results of this microarray analysis are summarized below in Table 15.

TABLE 15

| SEQ ID NO: | CLONE ID # | Ratio | Mean Signal 1 | Mean Signal 2 |
|---|---|---|---|---|
| 1383 | 50096 (contig 156) | 16.04 | 1.895 | 0.118 |
| 1560 | 54454 (contig 234) | 2.86 | 0.2 | 0.07 |
| 1561 | 54463 (contig 235) | 3.31 | 0.248 | 0.075 |
| 1707 | 59376 | 3.23 | 0.734 | 0.227 |
| 1733 | 61090 | 2.68 | 0.364 | 0.136 |
| 1735 | 61093 | 5.7 | 0.687 | 0.121 |
| 1758 | 61137 | 8.63 | 1.463 | 0.17 |
| 1761 | 61144 | 7.02 | 0.783 | 0.112 |
| 1766 | 61159 | 4.57 | 0.831 | 0.182 |
| 1771 | 61173 | 5.57 | 1.075 | 0.193 |
| 1775 | 61185 | 5.29 | 0.962 | 0.182 |
| 1786 | 61225 | 3.41 | 0.379 | 0.111 |

Real-time PCR anaylsis was performed on these sequences on a small cell lung carcinoma panel as described in Example 7. The results obtained from the real-time PCR analysis are summarized in Table 16.

TABLE 16

| SEQ ID NO: | Real-Time PCR Results |
|---|---|
| 1383 | On the SCLC panel, this gene is overexpressed in 2/2 primary small cell carcinoma and 6/6 SCLC cell lines. Some expression is also seen in normal brain, pituitary gland, spinal cord, and thymus. |
| 1560 | On the SCLC panel, this gene is overexpressed in 2/2 primary small cell carcinomas and 3/6 SCLC cell lines. Expression is also seen in normal brain and pituitary gland. |
| 1561 | On the SCLC panel, this gene is overexpressed in 2/2 primary small cell carcinomas, 6/6 SCLC cell lines, 1/1 atypical carcinoid metastases, adenocarcinoma, and squamous cell carcinoma pools. Expression is also seen in normal bone marrow, lymph node, thymus, and at lower levels in other normal tissues. |
| 1707 | On the SCLC panel, this gene is overexpressed in 1/6 SCLC cell lines and 0/2 primary small cell carcinomas. It is also expressed in normal stomach and at lower levels in normal brain, salivary gland, and trachea. |
| 1733 | On the SCLC panel, this gene is overexpressed in 2/2 primary small cell carcinomas, 6/6 SCLC cell lines, 1/1 atypical carcinoid metastases, adenocarcinoma, and squamous cell carcinoma pools. Some expression is also seen in normal bone marrow, lymph node, thyms, and at lower levels in other normal tissues. |
| 1735 | On the SCLC panel, this gene is overexpressed in 2/2 primary small cell carcinomas, 5/6 SCLC cell lines, 0/1 atypical carcinoid metastases, and adenocarcinoma pool. Lower level expression is also seen in normal bone marrow and skeletal muscle. |
| 1758 | On the SCLC panel, this gene is overexpressed in 2/2 primary small cell carcinomas, 6/6 SCLC cell lines, 0/1 atypical carcinoid metastases, adenocarcinoma, and squamous cell carcinoma pools. Some expression is also seen in normal bone marrow, thyroid gland, and trachea. |
| 1761 | On the SCLC panel, this gene is overexpressed in 2/2 primary small cell carcinomas, 6/6 SCLC cell lines, 0/1 atypical carcinoid metastases, adenocarcinoma, and squamous cell carcinoma pools. Expression is also seen in normal bone marrow. |
| 1766 | On the SCLC panel, this gene is overexpressed in 2/2 primary small cell carcinomas, 6/6 SCLC cell lines, and 0/1 atypical carcinoid metastases. Expression is also seen in normal pituitary gland, adrenal gland, bone marrow, thymus, salivary gland, and at lower levels in a variety of other normal tissues. |
| 1771 | On the SCLC panel, this gene is overexpressed in 2/2 primary small cell carcinomas, 6/6 SCLC cell lines, 0/1 atypical carcinoid metastases, and squamous cell carcinoma pools. Some expression is also seen in normal pituitary gland. |

TABLE 16-continued

| SEQ ID NO: | Real-Time PCR Results |
|---|---|
| 1775 | On the SCLC panel, this gene is overexpressed in 2/2 primary small cell carcinomas, adenocarcinoma, and squamous cell carcinoma pools. No expression is observed in the SCLC cell lines and the atypical carcinoid metastases. Some normal tissue expression is seen in liver, stomach, thyroid gland, lymph node, and thymus. |
| 1776 | On the SCLC panel, this gene is overexpressed in 2/2 primary small cell carcinomas, 6/6 SCLC cell lines, adenocarcinoma, and squamous cell carcinoma pools. Some expression is also seen in normal bone marrow, pituitary gland, stomach, trachea, and thymus. |

These sequences were then compared to known sequences in the available databases (Genbank, GeneSeq, huEST, etc.). Nine of these sequences showed some degree of similarity to known sequences in the available databases. The results of these nine hits are summarized in Table 17 along with providing sequence listing identifiers for the DNA sequences and the respective encoded amino acid sequences (where available) of these matches. SEQ ID NO:1561 and 1786 showed no significant similiarity to any known sequences.

TABLE 17

| SEQ ID NO: | GenBank Database Hit | GeneSeq. Hit | cDNA Seq. of Hit | Amino Acid Seq. Of Hit (if Known) |
|---|---|---|---|---|
| 1383 | Pr22 Protein/Stathmin/Oncoprotein 18 | A16376, A08801, A01633 | 1891 | 1901 |
| 1560 | CDNA DKFZp564O163 | — | 1892 | — |
| 1561 | Novel | Human secreted protein 5' EST. (C30107) | — | — |
| 1707 | SOX21 (AF107044) | Human secreted protein gene 7 cloone HE8CV18. (X27317) | 1893 | 1902 |
| 1733 | KIAA0166 gene (D79988) | Human gene signature HUMGS08725. (T26483) | 1894 | 1903 |
| 1735 | Ubiquitin-conjugating enzyme E2 (AF160215) | DNA encoding human ubiquitin-like conjugating protein (UBCLE). (X81676) | 1895 | 1904 |
| 1758 | Pituitary tumor transforming gene protein 1 (AF095287) | Z97293, X89295, V36964, V63198, Z97292, C00858, V88346, Z80287 | 1896 | 1905 |
| 1761 | Novel | Kidney injury associated molecule HW051 cDNA clone. (V80605) | 1897 | 1906 |
| 1766 | Cyclin-dependent kinase inhibitor p18 (CDKN2C) (AF041248) | Cyclin-dependent kinase (CDK6) inhibiting protein. (T10925; T31456) | 1898 | 1907 |
| 1771 | CDK4-inhibitor (p16-INK4) (L27211) | Multiple Matches | 1899 | 1908 |
| 1775 | Monokine induced by gamma interferon (MIG) (NM_002416) | Monokine induced by gammer-interferon. (X14998; Z26088) | 1900 | 1909 |
| 1776 | Novel | — | — | — |

Further studies have resulted in isolation of the full-length cDNA sequence for the cloned sequence of clone #61093 (SEQ ID NO:1735, L1437P). In order to determine the transcript size of the gene, a multiple tissue Northern blot was probed with the radioactively labeled original cloned sequence (SEQ ID NO:1735). The Northern blot included about 20 ug of total RNA from small cell lung carcinoma and normal tissues samples. Visual analysis of the exposed film revealed a single transcript of approximately 1.2 kb. The full-length sequence was obtained by screening a small cell lung carcinoma tumor cDNA library with the radioactively labeled probe of the original cloned sequence (SEQ ID NO:1735). Approximately 120,000 clones from the cDNA library were screened and 2 independent clones containing a cDNA insert of 931 bases were isolated. The inserts are similar in size to that estimated by Northern Blot analysis. The full-length cDNA sequence is provided in SEQ ID NO:1910. It was discovered that there was one nucleotide difference between the full-length cDNA and a previously published sequence. However, this nucleotide change does not result in a change in the deduced amino acid sequence. The deduced amino acid sequence encoded by the full-length cDNA is the same as already provided in SEQ ID NO:1904, and confirms earlier predictions that this cDNA encodes a known protein, ubiquitin-conjugated enzyme E2 (AF160215, SEQ ID NO:1904). SEQ ID NO:1910 (L1437P) was shown to be over-expressed in lung small cell lung carcinoma by microarray, real-time PCR and Northern Blot analysis.

EXAMPLE 14

Expression in *E. Coli* of a L548S His Tag Fusion Protein

PCR was performed on the L548S coding region with the following primers:

Forward primer PDM-433 5' gctaaaggtgaccccaagaaac-caaag 3' (SEQ ID NO:1911) Tm 60° C.

Reverse primer PDM-438 5' ctattaactcgagggagacagataaa-cagtttcttta 3' (SEQ ID NO:1912) TM 61° C.

The PCR conditions were as follows:
10 µl 10×Pfu buffer
1.0 µl 10 mM dNTPs
2.0 µl 10 µM each primer
83 µl sterile water
1.5 µl Pfu DNA polymerase (Stratagene, La Jolla, Calif.)
50 ng DNA
96° C. for 2 minutes, 96° C. for 20 seconds, 61° C. for 15 seconds, 72° C. for 1 minute 30 seconds with 40 cycles and then 72° C. for 4 minutes.

The PCR product was digested with XhoI restriction enzyme, gel purified and then cloned into pPDM His, a modified pET28 vector with a His tag in frame, which had been digested with Eco72I and XhoI restriction enzymes. The correct construct was confirmed by DNA sequence analysis and then transformed into BL21 CodonPlus (Stratagene, La Jolla, Calif.) and BL21 pLys S (Novagen, Madison, Wis.) cells for expression.

The amino acid sequence of expressed recombinant L548S is shown in SEQ ID NO:1913, and the DNA coding region sequence is shown in SEQ ID NO:1914.

EXAMPLE 15

Expression in *E. coli* of a L551L His Tag Fusion Protein

PCR was performed on the L551S coding region with the following primers:

Forward primer PDM-498 5' gtgacgatggaggagctgcgg-gagatgg 3' (SEQ ID NO:1915) Tm 67° C.

Reverse primer PDM-499 5' cgcctaactcgagtcactaacagctgg-gag 3' (SEQ ID NO:1916) TM 66° C.

The PCR conditions were as follows:
10 µl 10×Pfu buffer
1.0 µl 10 mM dNTPs
2.0 µl 10 mM each primer
83 µl sterile water
1.5 µl Pfu DNA polymerase (Stratagene, La Jolla, Calif.)
50 ηg DNA
96° C. for 2 minutes, 96° C. for 20 seconds, 66° C. for 15 seconds, 72° C. for 2 minutes 20 seconds with 40 cycles and then 72° C. for 4 minutes.

The PCR product was digested with XhoI restriction enzyme, gel purified and then cloned into pPDM His, a modified pET28 vector with a His tag in frame, which had been digested with Eco72I and XhoI restriction enzymes. The correct construct was confirmed by DNA sequence analysis and then transformed into BLR (DE3) pLys S and BLR (DE3) CodonPlus RP cells for expression.

The amino acid sequence of expressed recombinant L551S is shown in SEQ ID NO:1917, and the DNA coding region sequence is shown in SEQ ID NO:1918.

EXAMPLE 16

Expression in *E. coli* of a L552S His Tag Fusion Protein

PCR was performed on the L552S coding region with the following primers:

Forward primer PDM-479 5' cggtgccacgcccatggaccttc 3' (SEQ ID NO:1919) Tm 64° C.

Reverse primer PDM-480 5' ctgagaattcattaaacttgtggt-tgctcttcacc 3' (SEQ ID NO:1920) TM 62° C.

The PCR conditions were as follows:
10 µl 10×Pfu buffer
1.0 µl 10 mM dNTPs
2.0 µl 10 µM each primer
83 µl sterile water
1.5 µl Pfu DNA polymerase (Stratagene, La Jolla, Calif.)
50 ηg DNA
96° C. for 2 minutes, 96° C. for 20 seconds, 63° C. for 15 seconds, 72° C. for 1 minute with 40 cycles and then 72° C. for 4 minutes.

The PCR product was digested with EcoRI restriction enzyme, gel purified and then cloned into pPDM His, a modified pET28 vector with a His tag in frame, which had been digested with Eco72I and EcoRI restriction enzymes. The correct construct was confirmed by DNA sequence analysis and then transformed into BL21 CodonPlus (Stratagene, La Jolla, Calif.) cells for expression.

The amino acid sequence of expressed recombinant L552S is shown in SEQ ID NO:1921, and the DNA coding region sequence is shown in SEQ ID NO:1922.

EXAMPLE 17

Cloning of cDNA Encoding Full-Length Clones #19069 and Clone #189650 or #19002

Partial sequences of two lung antigens, clones #19069 (SEQ ID NO:90) and #18965 or #19002 (both SEQ ID NO:15), were previously provided. These partial sequences were used as a query to predict the full-length cDNA sequences for the isolated cloned sequenced by searching the publicly available databases. The predicted full-length cDNA sequence for the isolated cloned sequence of SEQ ID NO:90 is provided in SEQ ID NO:1923. The predicted full-length cDNA sequence for the isolated cloned sequence of SEQ ID NO:15 is provided in SEQ ID NO:1924. The deduced amino acid sequences of the two antigens are provided in SEQ ID NO:1925 and 1926, respectively These sequences were then compared to known sequences in the GeneSeq database. Both sequences showed some degree of similarity to known sequences in the GeneSeq database. SEQ ID NO:1923 shows similarity to a lipophosphatic acid acyltransferase (GeneSeq Z25000 and Z65038) and SEQ ID NO:1924 shows similarity to a zinc/iron regulated transporter-like protein (Geneseq Z38333 and A14995).

EXAMPLE 18

Epitope-Mapping of L552S-Specific Antibodies

This example describes the identification of specific epitopes recognized by L552S-specific antibodies. These experiments further confirm the immunogenicity of the L552S protein and support its use as a target for vaccine and/or other immunotherapeutic approaches.

Peptides of candidate antigens can be used for the evaluation of antibody responses in both preclinical and clinical studies. These data allow one to further confirm the antibody response against a certain candidate antigen. Protein-based ELISA with and without competitive peptides and peptide-based ELISA can be used to evaluate these antibody responses. Peptide ELISA is especially useful since it can further exclude the false positive of the antibody titer observed in protein-based ELISA as well as to provide the simplest assay system to test antibody responses to candidate antigens. In this example, data was obtained using L552S-peptides that show that individual cancer patients produce L552S-specific antibodies recognizing primarily the following three epitopes of L552S:

```
(1) aa21-35:
    GPRSGGAQAKLGCCW           (SEQ ID NO:1927)

(2) aa116-135:
    KVICKSCISQTPGINLDLGS      (SEQ ID NO:1928)

(3) aa141-160:
    IIPKEEHCKMPEAGEEQPQV      (SEQ ID NO:1929)
```

In further studies, it was found that affinity-purified antibodies generated by SEQ ID NO:1929 can recognize the L552S protein, and occupy about 0.6% of the total immunoglobulin kappa of a patient's lung plural effusion (LPE) fluid. It was also found that SEQ ID NO:1929 is the dominant epitope of the rabbit polyclonal antibodies specific for L552S protein.

The experiments described above further confirm the immunogenicity of the L552S lung tumor antigen and support its use as a target for vaccine and other immunotherapeutic approaches. Further, the above experiments identify specific epitopes of the L552S protein that may be of particular importance in the deveolpment of such approaches.

EXAMPLE 19

L985P Expression

For recombinant expression in mammalian cells, the full length L985P cDNA was subcloned into the mammalian expression vector pCEP4 (Invitrogen) with and without a FLAG epitope tag. Both constructs were transfected into HEK293 cells (ATCC) using Lipofectamine 2000 reagent (Invitrogen). Western blot analysis was then performed on these transfected cells to determine if recombinant L985P was being transiently expressed.

Briefly the transfection was carried out as follows. HEK cells were plated at a density of 350,000 cells/well (6 well plate) in DMEM (Gibco) containing 10% FBS (Hyclone) and grown overnight. The following day, 2 µl of Lipofectamine 2000 (Invitrogen) was added to 50 µl of Optimem 1 (Invitrogen) containing no FBS and incubated for 5 minutes at room temperature. In a different set of tubes 50 µl of Optimem 1 was mixed with 0.8 µg of L985P (with and without FLAG)/plasmid DNA and the mixture was transferred to the Lipofectamine 2000/Optimem mix. The combined mixture was incubated for 20 minutes at room temperature and transferred to the HEK293 cells containing 0.5 ml of DMEM 10% FBS. The Lipofectamine 2000/DNA mix was then added to the HEK293 cells and incubated for 16-24 hrs at 37° C. with 7% $CO_2$. Cells were rinsed with PBS then collected and pelleted by centrifugation.

For Western blot analysis, whole cell lysates were generated by incubating the cells in Triton-X100 containing lysis buffer for 30 minutes on ice. Lysates were then cleared by centrifugation at 15,000 rpm for 5 minutes at 4° C. Samples were diluted with SDS-PAGE loading buffer containing beta-mercaptoethanol, then boiled for 10 minutes prior to loading on the SDS-PAGE gel. The protein was transferred to nitrocellulose and probed using a purified anti-L985P rabbit polyclonal sera at a dilution of 1:1000. The blot was revealed with a donkey anti-rabbit Ig coupled to HRP (Jackson ImmunoResearch) followed by incubation in ECL substrate. Results of the blot indicate that recombinant L985P (with and without the FLAG) was expressed in the HEK293 cells.

EXAMPLE 20

Generation of Polyclonal Antibodies to Lung Tumor Antigens

This example describes the generation of polyclonal antibodies specific for the lung tumor antigens, L548S, L552S, and L985P. These data show that these lung tumor antigens are immunogenic and support their use to generate B cell immune responses in vivo. Further, the antibodies generated herein can be used in diagnostic and passive immunotherapeutic applications.

Three lung antigens, L548S (SEQ ID NO:789), L552S (SEQ ID NO:809) and L985P peptide #3482 (SEQ ID NO:1930), were expressed and purified for use in antibody generation.

L548S and L552S were expressed in an *E. coli* recombinant expression system and grown overnight in LB Broth with the appropriate antibiotics at 37° C. in a shaking incubator. The next morning, 10 ml of the overnight culture was added to 500 ml of 2×YT with the appropriate antibiotics in a 2L-baffled Erlenmeyer flask. When the optical density of the culture reached 0.4-0.6 at 560 nanometers, the cells were induced with IPTG (1 mM). Four hours after induction with IPTG, the cells were harvested by centrifugation.

The cells were then washed with phosphate buffered saline and centrifuged again. The supernatant was discarded and the cells were either frozen for future use or immediately processed. Twenty milliliters of lysis buffer was added to the cell pellets and vortexed. To break open the *E. coli* cells, this mixture was then run through a french press at a pressure of 16,000 psi. The cells were then centrifuged again and the supernatant and pellet were checked by SDS-PAGE for the partitioning of the recombinant protein.

For proteins that localized to the cell pellet, the pellet was resuspended in 10 mM Tris pH 8.0, 1% CHAPS and the inclusion body pellet was washed and centrifuged again. This procedure was repeated twice more. The washed inclusion body pellet was solubilized with either 8M urea or 6M guanidine HCl containing 10 mM Tris pH 8.0 plus 10 mM imidazole. The solubilized protein was added to 5 ml of nickel-chelate resin (Qiagen) and incubated for 45 minutes to 1 hour at room temperature with continuous agitation.

After incubation, the resin and protein mixture was poured through a disposable column and the flow through was collected. The column was then washed with 10-20 column volumes of the solubilization buffer. The antigen was then eluted from the column using 8M urea, 10 mM Tris pH 8.0 and 300 mM imidazole and collected in 3 ml fractions. A SDS-PAGE gel was run to determine which fractions to pool for further purification.

As a final purification step, a strong anion exchange resin, in this case Hi-Prep Q (Biorad), was equilibrated with the appropriate buffer and the pooled fractions from above were loaded onto the column. Each antigen was eluted off the column with an increasing salt gradient. Fractions were collected as the column was run and another SDS-PAGE gel was run to determine which fractions from the column to pool.

The pooled fractions were dialyzed against 10 mM Tris pH 8.0. The release criteria were purity as determined by SDS-PAGE or HPLC, concentration as determined by Lowry assay or Amino Acid Analysis, identity as determined by amino terminal protein sequence, and endotoxin level was determined by the Limulus (LAL) assay. The proteins were then put in vials after filtration through a 0.22-micron filter and the antigens were frozen until needed for immunization.

The L985P peptide #3482 was synthesized and conjugated to KLH and frozen until needed for immunization.

The polyclonal antisera were generated using 400 micrograms of each lung antigen combined with 100 micrograms of muramyldipeptide (MDP). An equal volume of Incomplete Freund's Adjuvant (IFA) was added and then mixed and injected subcutaneously (S.C.) into a rabbit. After four weeks, the rabbit was S.C. boosted with 200 micrograms of antigen mixed with an equal volume of IFA. Thereafter the rabbit was I.V. boosted with 100 micrograms of antigen. The animal was bled seven days following each boost. The blood was then incubated at 4° C. for 12-24 hours followed by centrifugation to generate the sera.

The polyclonal antisera were characterized using 96 well plates coated with antigen and incubating with 50 microliters (typically 1 microgram/microliter) of the polyclonal antisera at 4° C. for 20 hours.

250 microliters of BSA blocking buffer was added to the wells and incubated at room temperature for 2 hours. Plates were washed 6 times with PBS/0.1% Tween. The rabbit sera were diluted in PBS/0.1% Tween/0.1% BSA. 50 microliters of diluted sera was added to each well and incubated at room temperature for 30 minutes. The plates were washed as described above, and then 50 microliters of goat anti-rabbit horseradish peroxidase (HRP) at a 1:10000 dilution was added and incubated at room temperature for 30 minutes.

The plates were washed as described above, and 100 microliters of TMB Microwell Peroxidase Substrate was added to each well. Following a 15-minute incubation in the dark at room temperature, the colorimetric reaction was stopped with 100 microliters of 1N $H_2SO_4$ and read immediately at 450 nm. All the polyclonal antibodies showed immunoreactivity to the appropriate antigen.

Tables 18-20 show the antibody reactivity of rabbit antisera in serial dilution to the three lung antigens, L548S, L552S and L985P peptide #3482. The first column shows the antibody dilutions. The columns "Pre-immune sera" indicate ELISA data for two experiments using pre-immune sera. These results are averaged in the fourth column. The columns "anti-L548S, L552S or #3482" indicate ELISA data for two experiments using sera from rabbits immunized as described above, using the respective antigen, referred to as either L548S, L552S or #3482 in the tables.

TABLE 18

| Antibody dilution | Pre-immune sera (1) | Pre-immune sera (2) | Average | Anti-L548S (1) | Anti-L548S (2) | Average |
|---|---|---|---|---|---|---|
| 1:1000 | 0.17 | 0.10 | 0.14 | 0.51 | 0.51 | 0.51 |
| 1:2000 | 0.12 | 0.09 | 0.11 | 0.30 | 0.30 | 0.30 |
| 1:4000 | 0.09 | 0.08 | 0.08 | 0.17 | 0.20 | 0.19 |
| 1:8000 | 0.09 | 0.07 | 0.08 | 0.12 | 0.13 | 0.12 |
| 1:16000 | 0.09 | 0.08 | 0.08 | 0.09 | 0.12 | 0.11 |
| 1:32000 | 0.09 | 0.08 | 0.09 | 0.08 | 0.09 | 0.09 |
| 1:64000 | 0.11 | 0.09 | 0.10 | 0.11 | 0.12 | 0.12 |
| 1:128000 | 0.10 | 0.08 | 0.09 | 0.08 | 0.09 | 0.08 |
| 1:256000 | 0.09 | 0.08 | 0.08 | 0.11 | 0.09 | 0.10 |
| 1:512000 | 0.11 | 0.09 | 0.10 | 0.08 | 0.08 | 0.08 |
| 1:1024000 | 0.10 | 0.08 | 0.09 | 0.08 | 0.10 | 0.09 |
| 1:2048000 | 0.10 | 0.09 | 0.09 | 0.08 | 0.09 | 0.09 |

TABLE 19

| Antibody dilution | Pre-immune sera (1) | Pre-immune sera (2) | Average | Anti-L552S (1) | Anti-L552S (2) | Average |
|---|---|---|---|---|---|---|
| 1:1000 | 0.08 | 0.19 | 0.13 | 2.14 | 2.03 | 2.08 |
| 1:2000 | 0.08 | 0.06 | 0.07 | 1.93 | 1.97 | 1.95 |
| 1:4000 | 0.07 | 0.06 | 0.06 | 1.81 | 1.82 | 1.82 |
| 1:8000 | 0.08 | 0.06 | 0.07 | 1.63 | 1.64 | 1.64 |
| 1:16000 | 0.06 | 0.05 | 0.05 | 1.47 | 1.29 | 1.38 |
| 1:32000 | 0.06 | 0.05 | 0.06 | 1.03 | 1.10 | 1.06 |
| 1:64000 | 0.06 | 0.06 | 0.06 | 0.73 | 0.69 | 0.71 |
| 1:128000 | 0.06 | 0.05 | 0.06 | 0.44 | 0.48 | 0.46 |
| 1:256000 | 0.06 | 0.06 | 0.06 | 0.26 | 0.25 | 0.26 |
| 1:512000 | 0.07 | 0.06 | 0.06 | 0.16 | 0.15 | 0.16 |
| 1:1024000 | 0.06 | 0.07 | 0.06 | 0.12 | 0.10 | 0.11 |
| 0.00 | 0.06 | 0.06 | 0.06 | 0.06 | 0.06 | 0.06 |

TABLE 20

| Antibody dilution | Pre-immune sera (1) | Pre-immune sera (2) | Average | Anti-#3482 (1) | Anti-#3482 (2) | Average |
|---|---|---|---|---|---|---|
| 1:1000 | 0.10 | 0.07 | 0.09 | 2.10 | 2.07 | 2.08 |
| 1:2000 | 0.07 | 0.07 | 0.07 | 1.80 | 1.84 | 1.82 |
| 1:4000 | 0.07 | 0.06 | 0.06 | 1.78 | 1.80 | 1.79 |
| 1:8000 | 0.06 | 0.06 | 0.06 | 1.94 | 1.72 | 1.83 |
| 1:16000 | 0.06 | 0.06 | 0.06 | 1.75 | 1.74 | 1.74 |
| 1:32000 | 0.06 | 0.06 | 0.06 | 1.42 | 1.47 | 1.44 |
| 1:64000 | 0.06 | 0.06 | 0.06 | 1.12 | 1.17 | 1.14 |
| 1:128000 | 0.06 | 0.06 | 0.06 | 0.79 | 0.87 | 0.83 |
| 1:256000 | 0.06 | 0.06 | 0.06 | 0.70 | 0.65 | 0.68 |
| 1:512000 | 0.06 | 0.06 | 0.06 | 0.41 | 0.41 | 0.41 |
| 1:1024000 | 0.06 | 0.06 | 0.06 | 0.25 | 0.25 | 0.25 |
| 0 | 0.06 | 0.06 | 0.06 | 0.06 | 0.06 | 0.06 |

Table 21 shows the Protein A purification of the antibodies to the lung antigen, L548S.

TABLE 21

| Purified Antibody Concentration (µg/ml) | Pro A pure | Pro A pure | Average |
|---|---|---|---|
| 3.0 | 2.20 | 2.12 | 2.16 |
| 1.5 | 2.09 | 2.01 | 2.05 |
| 0.75 | 1.95 | 1.93 | 1.94 |
| 0.38 | 1.83 | 1.85 | 1.84 |
| 0.188 | 1.68 | 1.68 | 1.68 |
| 0.094 | 1.36 | 1.38 | 1.37 |
| 0.047 | 1.02 | 1.06 | 1.04 |
| 0.0234 | 0.68 | 0.73 | 0.71 |
| 0.0177 | 0.40 | 0.42 | 0.41 |
| 0.0059 | 0.24 | 0.25 | 0.24 |
| 0.0029 | 0.17 | 0.15 | 0.16 |
| 0.00 | 0.06 | 0.06 | 0.06 |

Table 22 shows the affinity purification of the antibodies to the lung antigen, L552S.

TABLE 22

| Antibody dilution | Affinity pure (salt peak) | Affinity pure (salt peak) | Average | Antibody dilution | Affinity pure (acid peak) | Affinity pure (acid peak) | Average |
|---|---|---|---|---|---|---|---|
| 1:50 | 0.19 | 0.18 | 0.18 | 1:1000 | 2.22 | 2.20 | 2.21 |
| 1:100 | 0.10 | 0.09 | 0.10 | 1:2000 | 2.17 | 2.10 | 2.13 |
| 1:200 | 0.06 | 0.06 | 0.06 | 1:4000 | 2.05 | 2.06 | 2.06 |
| 1:400 | 0.06 | 0.06 | 0.06 | 1:8000 | 1.95 | 1.94 | 1.95 |
| 1:800 | 0.06 | 0.05 | 0.06 | 1:16000 | 1.86 | 1.82 | 1.84 |
| 1:1600 | 0.06 | 0.06 | 0.06 | 1:32000 | 1.64 | 1.57 | 1.61 |
| 1:3200 | 0.06 | 0.06 | 0.06 | 1:64000 | 1.28 | 1.26 | 127 |
| 1:6400 | 0.06 | 0.06 | 0.06 | 1:128000 | 0.88 | 0.87 | 0.88 |
| 1:12800 | 0.06 | 0.06 | 0.06 | 1:256000 | 0.56 | 0.56 | 0.56 |
| 1:25600 | 0.06 | 0.06 | 0.06 | 1:512000 | 0.35 | 0.34 | 0.34 |
| 1:51200 | 0.06 | 0.06 | 0.06 | 1:1024000 | 0.18 | 0.17 | 0.18 |
| 0.00 | 0.06 | 0.06 | 0.06 | 0.00 | 0.06 | 0.06 | 0.06 |

Tables 23A and 23B show the affinity purification and the Protein A purification of the antibodies to the lung antigen L985P peptide #3482.

TABLE 23A

| Purified Antibody Concentration (µg/ml) | Affinity pure | Affinity pure | Average |
|---|---|---|---|
| 3.0 | 1.73 | 1.69 | 1.71 |
| 1.50 | 1.32 | 1.28 | 1.30 |
| 0.75 | 0.96 | 0.91 | 0.93 |
| 0.38 | 0.63 | 0.61 | 0.62 |
| 0.19 | 0.38 | 0.39 | 0.38 |
| 0.09 | 0.19 | 0.20 | 0.19 |
| 0.05 | 0.16 | 0.10 | 0.13 |
| 0.02 | 0.12 | 0.15 | 0.13 |

TABLE 23B

| Purified Antibody Concentration (µg/ml) | Pro A pure | Pro A pure | Average |
|---|---|---|---|
| 40.70 | 1.80 | 1.91 | 1.85 |
| 20.35 | 1.54 | 1.53 | 1.53 |
| 10.18 | 1.04 | 1.18 | 1.11 |
| 5.09 | 0.71 | 0.78 | 0.74 |

TABLE 23B-continued

| Purified Antibody Concentration (μg/ml) | Pro A pure | Pro A pure | Average |
|---|---|---|---|
| 2.54 | 0.43 | 0.52 | 0.48 |
| 1.27 | 0.25 | 0.28 | 0.26 |
| 0.64 | 0.13 | 0.20 | 0.17 |
| 0.32 | 0.10 | | 0.10 |

The data described in the above example show that the lung tumor antigens, L548S, L552S, and L985P are immunogenic and can be used to generate B cell immune responses in vivo. Further, the antibodies generated herein have utility in diagnostic and passive immunotherapeutic applications.

EXAMPLE 21

Cloning of Extended cDNA Sequence of L1439P

The partial cDNA sequence for clone #61144 (SEQ ID NO:1761, referred to as clone L1439P) was identified from a small cell lung carcinoma PCR based subtraction library on lung chip 5. As previously disclosed in Example 4, microarray analysis was performed on this subset of the lung tumor sequences in order to further evaluate their expression profiles in various tumor and normal tissues, the results of which are provided in Table 11. Clone L1439P was shown to have a greater than 2-fold over-expression in the tumor probe group versus normal tissues and an average expression in normal tissues of less than 0.2. Additional studies showed this same clone to be over-expressed in a subset of small cell lung carcinomas (see, Table 16).

Further studies have resulted in the isolation of the full-length cDNA for the cloned sequence of L1439P. In order to determine the transcript size of the gene, a multiple tissue Northern blot was probed with the radioactively labeled original cloned sequence (SEQ ID NO:1180). The Northern blot included about 10 ug of total RNA from small cell lung carcinoma and normal tissues samples. Visual analysis of the exposed film revealed a single transcript of approximately 2.4 kb. The extended sequence of the clone was obtained by screening a small cell lung carcinoma tumor cDNA library with a radioactively labeled probe of the original cloned sequence (SEQ ID NO:1761). Approximately 120,000 clones from the cDNA library were screened and one independent clone containing a cDNA insert of 1.5 kb was isolated. This extended cDNA sequence is provided in SEQ ID NO:1931, and the deduced amino acid sequence encoded by this extended cDNA sequence is provided in SEQ ID NO:1932. This extended cDNA sequence was analyzed against the Genbank database and was found to show similarity to the NUF2R gene (AF326731). The full-length cDNA sequence of NUF2R is provided in SEQ ID NO:1933, and the deduced amino acid sequence encoded by NUF2R is provided in SEQ ID NO:1934.

EXAMPLE 22

Expression in Megaterium of a Histidine Tag-Free L552S Fusion Protein

PCR was performed on the L552S coding region with the following primers:
Forward primer PDM-737 5' ctatgttggcatgcggtgccacgcc 3' (SEQ ID NO:1935) Tm 66° C.
Reverse primer PDM-738 5' cacgcctaagatcttcattaaacttgtggttg 3' (SEQ ID NO:1936) TM 60° C.
The PCR conditions were as follows:
10 μl 10×Pfu buffer
1.0 μl 10 mM dNTPs
2.0 μl 10 μM each primer
83 μl sterile water
1.5 μl Pfu DNA polymerase (Stratagene, La Jolla, Calif.)
50 ηg DNA
96° C. for 2 minutes, 96° C. for 20 seconds, 63° C. for 15 seconds, 72° C. for 1 minute with 40 cycles and then 72° C. for 4 minutes.

The PCR product was digested with SphI and BglII restriction enzymes, gel purified and then cloned into pMEG-3, which had been digested with SphI and BglII restriction enzymes. The correct construct was confirmed by DNA sequence analysis and then transformed into Megaterium cells for expression.

The amino acid sequence of expressed recombinant L552S is shown in SEQ ID NO:1937, and the DNA coding region sequence is shown in SEQ ID NO:1938.

EXAMPLE 23

Expression in *E. Coli* of a Histidine Tag-Free L552S Fusion Protein

PCR was performed on the L552S coding region with the following primers:
Forward primer PDM-736 5' ctatgttgcatatgcggtgccacgcc 3' (SEQ ID NO:1939) Tm 64° C.
Reverse primer PDM-480 5' ctgagaattcattaaacttgtggtgctcttcacc 3' (SEQ ID NO:1920) TM 62° C.
The PCR conditions were as follows:
10 μl 10×Pfu buffer
1.0 μl 10 mM dNTPs
2.0 μl 10 μM each primer
83 μl sterile water
1.5 μl Pfu DNA polymerase (Stratagene, La Jolla, Calif.)
50 ηg DNA
96° C. for 2 minutes, 96° C. for 20 seconds, 63° C. for 15 seconds, 72° C. for 1 minute with 40 cycles and then 72° C. for 4 minutes.

The PCR product was digested with NdeI and EcoRI restriction enzymes, gel purified and then cloned into pPDM, a modified pET28 vector, which had been digested with NdeI and EcoRI restriction enzymes. The correct construct was confirmed by DNA sequence analysis and then transformed into BLR pLys S and HMS 174 pLysS cells for expression.

The amino acid sequence of expressed recombinant L552S is shown in SEQ ID NO:1940, and the DNA coding region sequence is shown in SEQ ID NO:1941.

EXAMPLE 24

Generation of L552S-Specific CTL Lines Using In Vitro Whole-Gene Priming

This example describes the generation of L552S-specific cytotoxic T cell (CTL) lines. These experiments support the fact that the L552S protein is immunogenic and support its use as a target for vaccines and immunotherapeutics.

Using in vitro whole-gene priming with tumor antigen-vaccinia infected DC (Yee et al, *The Journal of Immunology*, 157(9):4079-86, 1996), human CTL lines were derived that specifically recognize autologous fibroblasts transduced with the L552S tumor antigen, as determined by interferon-gamma ELISPOT analysis. Specifically, dendritic cells (DC) were differentiated from Percoll-purified monocytes derived from PBMC of normal human donors by growing for five days in RPMI medium containing 10% human serum, 50 ng/ml human GM-CSF and 30 ng/ml human IL-4. Following culture, DC were infected overnight with a recombinant adenovirus that expresses L552S at a multiplicity of infection (M.O.I) of five, and matured overnight by the addition of 2 µg/ml CD40 ligand. Virus was then inactivated by UV irradiation. CD8+ cells were enriched for by the depletion of CD4+ and CD14+cells. CD8+ T cells were isolated using a magnetic bead system, and priming cultures were initiated in individual wells of six 96-well plates with the cytokines IL-6 and IL-12. Cultures were restimulated every 7-10 days using autologous primary fibroblasts retrovirally transduced with L552S, and the costimulatory molecule CD80 in the presence of IL-2. Following three stimulation cycles, two CD8+ T cell lines, 2-12G and 4-7A, were identified using interferon-gamma ELISPOT analysis that specifically produce interferon-gamma when stimulated with the L552S tumor antigen-transduced autologous fibroblasts, but not with a control antigen. Both lines were restimulated and tested again in an antibody blocking assay to determine restriction to specific HLAs. Line 2-12G appears to be HLA-B/C restricted, while Line 4-7A appears to be HLA-A restricted. Line 2-12G was cloned using anti-CD3 and feeder cells, with fourteen specific clones being recovered. These clones have the same pattern of reactivity in antibody blocking assays as the parental L2-12G CTL line. In addition, using a panel of HLA-mismatched B-LCL lines transduced with a vector expressing L552S, and measuring interferon-gamma production by the CTL lines in an ELISPOT assay, these CTLs appear to be restricted by HLA-B*4402.

EXAMPLE 25

Epitope-Mapping of L552S- and Xage-1-Specific Antibodies

This example describes the identification of specific epitopes recognized by L552S-specific antibodies present in sera of lung cancer patients. These experiments further confirm the immunogenicity of the L552S protein and support its use as a target for vaccine and/or other immunotherapeutic approaches.

It was previously found that L552S is an alternative splicing isoform of XAGE-1. In this example, data was obtained using 20 mer peptides specific for either L552S or XAGE-1 to screen the sera of lung cancer patients for antibodies specific for L552S and XAGE-1, respectively. It was found that individual cancer patients produce both antibodies specific for L552S as well as for XAGE-1. It was determined that these specific antibodies recognize primarily the following additional epitope of L552S and two epitopes of XAGE-1:

L552S-specific:

```
aa31-50:    LGCCWGYPSPRSTWNDRPF    (SEQ ID NO:1942)
```

XAGE-1-specific:

```
aa11-30:    CSLGVFPSAPSPVWGTRRSC   (SEQ ID NO:1943)

aa41-50:    ILSPLLRHGGHTQTQNHTAS   (SEQ ID NO:1944).
```

The experiments described above further confirm the immunogenicity of the L552S lung tumor antigen and support its use as a target for vaccine and other immunotherapeutic approaches. Further, the above experiments identify specific epitopes of the L552S protein that may be of particular importance in the deveolpment of such approaches.

EXAMPLE 26

Immunohistochemistry Analysis of L552S

In order to determine L552S protein expression in various normal and lung cancer tissues, immunohistochemistry (IHC) analysis was performed using an affinity purified L552S polyclonal antibody. Specifically, tissue samples were fixed in a formalin solution for 12-24 hrs and embedded in paraffin before being sliced into 8 micron sections. Steam heat induced epitope retrieval (SHIER) in 0.1 M sodium citrate buffer (pH 6.0) was used for optimal staining conditions. Sections were incubated with 10% serum/PBS for 5 minutes. Primary antibody was added to each section for 25 minutes at indicated concentrations followed by a 25 minute incubation with either anti-rabbit or anti-mouse biotinylated antibody. Endogenous peroxidase activity was blocked by three-1.5 minute incubations with hydrogen peroxidase. The avidin biotin complex/horse radish peroxidase (ABC/HRP) system was used along with DAB chromogen to visualize L552S expression. Slides were counterstained with hematoxylin to visualize cell nuclei.

IHC analysis of L552S is disclosed in Table 24:

TABLE 24

| Tissue Type | Staining (pos/total) | Comments |
| --- | --- | --- |
| Adeno Lung Cancer | 10/12 | Strong staining (nuclear "dot-like") |
| Squamous Lung Cancer | 4/12 | Light staining (cytoplasmic "dot-like") |
| Adrenal | 0/1 | |
| Artery-endothelium | 0/1 | Light cytoplasmic staining |
| Blood (bone marrow) | 0/1 | |
| Brain (cerebellum) | 0/1 | |
| Brain (cortex) | 0/1 | |
| Breast | 0/1 | |
| Bronchus | 0/5 | |
| Colon | 1/4 | Very light staining (cytoplasmic "dot-like") |
| Esophagus | 0/1 | |
| Fallopian Tube | 0/1 | |
| Gall Bladder | 0/1 | |
| Heart | 0/1 | |
| Kidney | 2/4 | Very light staining (cytoplasmic "dot-like") |
| Liver | 1/4 | Very light staining (cytoplasmic "dot-like") |
| Lung | 0/13 | |
| Pancreas | 0/1 | |
| Pituitary | 1/1 | Very light staining (cytoplasmic "dot-like") |
| Placenta | 1/1 | Very light staining (cytoplasmic "dot-like") |
| Prostate | 0/1 | |
| Skeletal Muscle | 0/1 | |
| Skin | 0/1 | |
| Small Bowel | 0/1 | |
| Spinal Cord | 0/1 | |
| Spleen | 0/1 | |
| Stomach | 0/1 | |
| Testis | 1/2 | Very few selected cells positive |
| Thymus | 0/1 | |
| Thyroid | 0/1 | |
| Trachea | 0/1 | |
| Urinary Bladder | 0/1 | |
| Ureter | 0/1 | |
| Uterus | 0/1 | |

EXAMPLE 27

Identification of CD4 Immunogenic T Cell Epitopes Derived from L552S

This example describes the identification of specific epitopes recognized by L552S antigen-specific T cells. These experiments further confirm the immunogenicity of the L552S protein and support its use as a target for vaccine and/or other immunotherapeutic approaches.

CD4 T cell lines specific for the antigen L552S (SEQ ID NO:809) were generated as follows. A total of thirty 20-mer peptides overlapping by 15 amino acids corresponding to the amino acid residues of full-length L552S (SEQ ID NO:809) were synthesized. The amino acid sequence of each of the thirty 20-mer peptides and the respective DNA sequence which encodes each of these peptides is provided in Table 25. Dendritic cells (DC) were differentiated from Percoll-purified monocytes derived from PBMC of normal male human donors by plastic adherence and growing for five days in RPMI medium containing 10% human serum, 50 ng/ml human GM-CSF and 30 ng/ml human IL-4. Purified CD4 T cells were generated from the same donor as the DCs by using MACs beads and negative selection of PBMCs. The DCs were pulsed overnight with pools of the 20-mer peptides with each peptide at an individual concentration of 0.5 µg/mL. The pulsed DCs were washed and plated at 10,000 cells per well of 96-well round bottom plates, and purified CD4 T cells were added at 100,000 cells per well. Cultures were supplemented with 10 ng/mL IL-6 and 5 ng/mL IL-12 and incubated at 37° C.

Cultures were restimulated as above on a weekly basis using DCs made and pulsed as above as the APC, supplemented with 10 U/mL IL-2 and 5 ng/mL IL-7. Following three in vitro stimulation cycles (the initial priming+two restimulations), lines (each line corresponds to one well) were tested for specific proliferation and cytokine production in response to the stimulating pool versus an irrelevant peptide pool of peptides derived from assorted unrelated antigens. A number of individual CD4 T cell lines (49/576 by IFN-gamma and 63/576 by proliferation) demonstrated significant cytokine release (IFN-gamma) and proliferation in response to the L552S peptide pools, but not to the control peptide pool. Twenty five of the T cell lines which exhibited specific activity were restimulated on the appropriate pool of L552S peptides and reassayed on autologous DCs pulsed with the individual peptides or recombinant protein made in E. coli. Approximately 13 immunogenic peptides were recognized by the T cells from the entire set of peptide antigens tested. These 13 peptides are (*) in Table 25.

In some cases the peptide reactivity of the T cell line could be mapped to a single peptide but some could be mapped to more than one peptide in each pool. This result indicates that all 13 peptides may be naturally processed epitopes of the L552S protein.

TABLE 25

L552S CD4 Overlapping Peptides

| Peptide | Sequence | Peptide SEQ ID NO: | DNA SEQ ID NO: |
|---|---|---|---|
| 1 | MRCHAHGPSCLVTAITREEG | 1945 | 1974 |
| 2 | HGPSCLVTAITREEGGPRSG | 1946 | 1975 |
| 3 | LVTAITREEGGPRSGGAQAK | 1947 | 1976 |
| 4* | TREEGGPRSGGAQAKLGCCW | 1948 | 1977 |
| 5* | GPRSGGAQAKLGCCWGYPSP | 1949 | 1978 |

TABLE 25-continued

L552S CD4 Overlapping Peptides

| Peptide | Sequence | Peptide SEQ ID NO: | DNA SEQ ID NO: |
|---|---|---|---|
| 6* | GAQAKLGCCWGYPSPRSTWN | 1950 | 1979 |
| 7* | LGCCWGYPSPRSTWNPDRRF | 1951 | 1980 |
| 8 | GYPSPRSTWNPDRRFWTPQT | 1952 | 1981 |
| 9 | RSTWNPDRRFWTPQTGPGEG | 1953 | 1982 |
| 10 | PDRRFWTPQTGPGEGRHERH | 1954 | 1983 |
| 11 | WTPQTGPGEGRHERHTQTQN | 1955 | 1984 |
| 12 | GPGEGRHERHTQTQNHTASP | 1956 | 1985 |
| 13 | RHERHTQTQNHTASPRSPVM | 1957 | 1986 |
| 14 | TQTQNHTASPRSPVMESPKK | 1958 | 1987 |
| 15* | HTASPRSPVMESPKKKNQQL | 1959 | 1988 |
| 16 | RSPVMESPKKKNQQLKVGIL | 1960 | 1989 |
| 17 | ESPKKKNQQLKVGILHLGSR | 1961 | 1990 |
| 18* | KNQQLKVGILHLGSRQKKIR | 1962 | 1991 |
| 19* | KVGILHLGSRQKKIRIQLRS | 1963 | 1992 |
| 20* | HLGSRQKKIRIQLRSQCATW | 1964 | 1993 |
| 21* | RQKKIRIQLRSQCATWKVICK | 1965 | 1994 |
| 22* | IQLRSQCATWKVICKSCISQ | 1966 | 1995 |
| 23* | SQCATWKVICKSCISQTPGIN | 1967 | 1996 |
| 24* | KVICKSCISQTPGINLDLGS | 1968 | 1997 |
| 25 | SCISQTPGINLDLGSGVKVK | 1969 | 1998 |
| 26 | TPGINLDLGSGVKVKIIPKE | 1970 | 1999 |
| 27* | LDLGSGVKVKIIPKEEHCKM | 1971 | 2000 |
| 28 | GVKVKIIPKEEHCKMPEAGE | 1972 | 2001 |
| 29 | IIPKEEHCKMPEAGEEQPQV | 1973 | 2002 |

The experiments described above further confirm the immunogenicicty of the L552S lung tumor antigen and support its use as a target for vaccine and other immunotherapeutic approaches. Further, the above experiments identify specific epitopes of the L552S protein that may be of particular importance in the deveolpment of such approaches.

EXAMPLE 28

HLA Restriction of an L552S-Specific CTL Clone

This example describes the determination of the HLA restriction of an L552S-specific cytotoxic T cell (CTL) clone and further shows that this clone recognizes L552-positive primary lung tumor cells. These experiments support the fact that the L552S protein is immunogenic and support its use as a target for vaccines and immunotherapeutics.

One of the CTL lines described in Example 24 was further cloned by limiting dilution, with fourteen specific clones recovered. To determine the HLA restriction of one of the clones, D77 L552 Clone 14, a panel of fibroblasts matched at one or two HLA alleles were transduced with pBIB L552 or infected with adenovirus L552 at an MOI of 50:1. These targets were tested against the D77 L552 CD8 clone in an ELISPOT assay with 10000 fibroblasts, 10000 T cells and 5 U/mL IL-2 per well. The results indicate that this clone is either restricted by B*4402 or Cw*0501.

To determine whether the CD8+ T cell clone is restricted by B*4402 or Cw*0501, COS-7 cells were transfected with a combination of pcDNA3 L552S and pcDNA3 B*4402 or pBIB Cw*0501. These targets were again tested against the same D77 L552 CD8 clone as above in an ELISPOT assay with 10000 COS-7, 10000 clone 14 and 5 U/mL IL-2 per well. The clone recognized the L552 and B*4402 transfected COS-7 cells, indicating that it is restricted by the HLA-B*4402 molecule.

In further studies, three different tumors, 659-22, 3-90T and HTB 183, that had been previously analyzed by real time RT-PCR for L552 message level were selected and transduced with either B*4402 or Cw*0501 as a control. 659-22 and 3-90T contain L552 message, while HTB 183 was the negative control. After two rounds of selection, the tumors were analyzed by FACs for their B44 expression level. 659-22 were found to endogenously express high levels of B44, but it was not determined which of the B44s, B*4402, B*4404, etc, were being expressed. Approximately 20% of the 3-90T express B44. The HTB 183 express B44 quite well. When the D77 L552 clone 14 described above was tested against these tumors, 659-22 transduced with B*4402 was recognized. Thus, the results further confirm that the D77 L552-specific CD8 clone is restricted by HLA-B*4402 and recognizes L552-positive primary lung tumor cells.

EXAMPLE 29

Expression of L552s and Xage-1

In this Example, real-time RT-PCR analysis was performed in order to delineate the expression of L552S from XAGE-1 in lung cancers. The real-time RT-PCR analysis was performed using specific primers localized in the 5' unique region of L552S, the 5' unique region of XAGE-1 and the 3' common region. Specific messages for L552S and XAGE-1 were detected in two lung tumor samples but not in the normal lung samples.

Identical expression profiles were observed between 5' unique region of L552S and the common 3' sequences. The message level for XAGE-1 detected in lung tumors using the 5' unique primers of XAGE-1 was much lower compared with L552S. However, the extreme secondary structure posed by XAGE-1 could hamper the cDNA synthesis of the 5' sequence unique to XAGE-1. Thus, it appears from the Northern analysis that XAGE-1 may be a more abundant isoform.

EXAMPLE 30

Est Expression Profile of L552S And Xage-1

To further evaluate the expression profile of L552S and XAGE-1, an electronic express profiling was performed for each antigen. This was done by searching with the same specific primers as disclosed in Example 29 against a public EST database. Results of this profiling confirm that there are two isoforms of the gene. The ratio of expression between L552S and XAGE-1 is about 1:5. In addition, L552S and XAGE-1 seem to be expressed in Hepatoma, CML, germ cell tumor, Ewing's Sarcoma, and Alveolar Rhabdomyosarcoma.

EXAMPLE 31

L985P Lung Tumor Antigen Surface Expression

Small cell lung carcinoma (SCLC) cell lines, NCI-H69, NCI-H128, HTB-171, HTB-173, HTB-175, and DMS 79, were grown in DMEM (Gibco) containing 10% FBS (Hyclone) at 37° C. with 7% $CO_2$. These growing SCLC cell lines were then subjected to FACS analysis to determine whether L985P is expressed on the surface of these SCLC cell lines using an anti L985P peptide polyclonal sera raised against the predicted excellular region of L985P.

For FACS analysis, cells were collected and washed with ice cold staining buffer (PBS+1% BSA+Azide+10 μg/ml human IgG). The cells were next incubated for one hour on ice either with no primary antibody, with irrelevant rabbit IgG, whole molecule at a final concentration of 20 μg/ml, or with affinity purified rabbit polyclonal sera raised against L985P peptide #3482 (SEQ ID NO:1930) at a final concentration of 20 μg/ml. The sequence of the L985P peptide #3482 (SEQ ID NO:1930) represents the predicted extracellular region of the L985P protein. The cells were washed 2 times with staining buffer and then incubated with a 1:100 dilution of a goat anti-rabbit Ig(H+L)-FITC reagent (Southern Biotechnology) for 30 minutes on ice. Following two washes, the cells were resuspended in staining buffer containing propidium iodide (PI), a vital stain that allows for identification of permeable cells, and analyzed by FACS.

In addition, Real-time PCR was performed to determined if L985P mRNA was expressed in these SCLC cell lines. The results of the FACS analysis and the Real time PCR of mRNA expression are presented in Table 26:

TABLE 26

| SCLC Cell Line | mRNA Expression by Real Time PCR | Surface Expression by FACS |
|---|---|---|
| NCI-H69 | + | + |
| HTB-173 | + | + |
| HTB-175 | − | − |
| HTB-171 | − | − |
| NCI-H128 | − | − |
| DMS 79 | − | − |

EXAMPLE 32

IHC Analysis of L985P Lung Tumor Antigen Expression

In order to determine which tissues express the lung cancer target L985P, immunohistochemistry (IHC) analysis was performed on cell lines and a diverse range of tissue sections. Tissue samples were fixed in formalin solution for 12-24 hours and embedded in paraffin before being sliced into 8 micron sections. Steam heat induced epitope retrieval (SHIER) in 0.1 M sodium citrate buffer (pH 6.0) was used for optimal staining conditions. Sections were incubated with 10% serum/PBS for 5 minutes. Primary antibody was added to each section for 25 minutes followed by 25 minute incubation with anti-rabbit biotinylated antibody. Endogenous peroxidase activity was blocked by three 1.5 minute incubations with hydrogen peroxidase. The avidin biotin complex/horse radish peroxidase (ABC/HRP) system was used along with DAB chromogen to visualize antigen expression. Slides were counterstained with hematoxylin to visualize cell nuclei.

To test specificity of the staining procedure, various cell lines and transfected cell lines were stained. Wild-type HEK cells did not stain while HEK/L985-flag stable transfectant cells, HEK/L985 stable transfectant cells, and NCI-H69 cells all stained positive. No staining was observed in HTB175 cells.

A variety of normal tissues were stained as described above. As summarized in Table 27, in addition to expression in lung, staining was observed in liver, kidney, small intestine, testis, endometrium, adrenal gland, adrenal cortex, and thymus.

TABLE 27

L985P IHC Analysis On Normal Tissue Array

| BD Tissue Array | | Imgenex Tissue Array | |
| --- | --- | --- | --- |
| Tissue Type | Cell Type Stained | Tissue Type | Cell Type Stained |
| Heart | | Heart | |
| Heart | | Skin, buttock | |
| Lung | tissue dropped | Lung | brush border of bronchiole epithelium |
| Lung | | Lung | |
| Liver | liver cells | Liver | liver cells |
| Liver | liver cells | Liver | liver cells |
| Spleen | | Spleen | |
| Spleen | | Spleen | |
| Kidney | renal tubule cells | Kidney cortex | renal tubule cells |
| Kidney | renal tubule cells | Kidney medulla | renal tubule cells |
| Stomach | | Stomach body | |
| Stomach | | Stomach antrum | |
| Small intestine | intestine epithelium | Stomach smooth muscle | |
| Small intestine | intestine epithelium | Duodenum | |
| Colon | | Ileum | |
| Colon | | Appendix | |
| Myometrium | | Colon | |
| Myometrium | | Sigmoid colon | |
| Ovary | | Ovary | |
| Ovary | | Ureter | |
| Prostate | | Urinary bladder | |
| Prostate | | Prostate | |
| Testis | Interstitial Leydig cells | Seminal vesical | |
| Testis | Interstitial Leydig cells | Testis | Interstitial Leydig cells |
| Endometrium | glandula epithelium | Epidydimis | |
| Endometrium | glandula epithelium | Endometrium, proliferative | glandula epithelium |
| Tonsil | | Endometrium, secretory | glandula epithelium |
| Tonsil | | Myometrium | |
| Thyroid | | Uterine cervix(endocervix) | |
| Thyroid | | Uterine cervix(exocervix) | |
| Adrenal gland | glandula cell | Salpinx | |
| Adrenal gland | glandula cell | Placenta, villi | |
| Artery | | Plancenta, aminochorion | |
| Artery | | Placenta cord | |
| Vein | | Adrenal cortex | glandula cells |
| Vein | | Adrenal cortex | glandula cells |
| Cerebrum | | Thyroid | |
| Cerebrum | | Thymus | medulla epithelia cells |
| Cerebellum | | Brain, white matter | |
| Cerebellum | | Brain, gray matter | |
| Smooth muscle | | Cerebellum | |
| Smooth muscle | | Spinal cord | |
| Pancreas | | | |
| Pancreas | | | |
| Skeletal muscle | | | |
| Skeletal muscle | | | |
| Cervix | | | |
| Cervix | | | |

EXAMPLE 33

Further Characterization of L985P Expression

The full length L985P cDNA with a glycine substitution at position 119 was PCR amplified from the small cell lung cancer (SCLC) cell lines NCI-H69 and HTB-173. The sequence for L985P Gly 119 (full-length cDNA: SEQ ID NO:2003; full-length protein: SEQ ID NO:2004) is the same as that of the previously disclosed sequence for CSIMM-2 available from the Geneseq database (cDNA: SEQ ID NO:1676; protein: SEQ ID NO:1677) and differs from the previously disclosed sequence for L985P (partial cDNA: SEQ ID NO:1467; full-length cDNA: 1873; full-length protein: SEQ ID NO:1874), which codes for a Glutamic acid at amino acid 119. Recombinant L985P protein containing a Gly at amino acid 119 was detected in transfected mammalian cell lysates using a rabbit polyclonal sera raised against a L985P peptide. Additionally, L985P Gly 119 was detected on the cell surface by flowcytometry using this rabbit polyclonal antibody. However, the previously disclosed L985P peptide sequence that contains a Glu at amino acid 119, does not efficiently localize to the plasma membrane. Therefore, as a surface target for monoclonal antibodies L985P Gly 119 is advantageous because it readily localizes to the plasma membrane. Thus, expression of L985P Gly 119 was further characterized in a mammalian expression system.

For recombinant expression in mammalian cells, the L985P Gly 119 cDNA (SEQ ID NO:2003) was subcloned into the mammalian expression vector pCEP4 (Invitrogen, Carlsbad, Calif.). The construct was transfected into HEK293 cells (American Type Culture Collection (ATCC), Manassas, Va.) using Lipofectamine 2000 reagent (Invitrogen, Carlsbad, Calif.). Briefly, the HEK cells were plated at a density of 350,000 cells/well (6 well plate) in DMEM (Gibco (Invitrogen Life Technologies, Carlsbad, Calif.) containing 10% FBS (Hyclone, Logan, Utah) and grown overnight. The following day, 2 ul of Lipofectamine 2000 (Invitrogen, Carlsbad, Calif.) was added to 50 ul of Optimem 1 (Invitrogen, Carlsbad, Calif.) containing no FBS and incubated for 5 minutes at RT. In a different tube 50 ul of Optimem 1 was mixed with 0.8 ug of L985P Gly 119 plasmid DNA and the mixture was transferred to the Lipofectamine 2000/Optimem mix. The combined mixture was incubated for 20 minutes at room temperature and transferred to the HEK293 cells containing 0.5 ml of DMEM 10% FBS. The Lipofectamine 2000/DNA mix was then added to the HEK293 cells and incubated for approximately 48 hrs at 37° C. with 7% CO2. Cells were rinsed with PBS then collected and pelleted by centrifugation.

For Western blot analysis, whole cell lysates were generated by adding 1×NuPAGE sample buffer (Invitrogen, Carlsbad, Calif.) containing 1% beta-mercaptoethanol directly to the cell pellet. The cell pellet was sonicated to homogenization, heated for 5 minutes at 70C, and loaded onto a 12% NuPAGE gel (Invitrogen, Carlsbad, Calif.). Protein was transferred to nitrocellulose and probed using a purified anti-L985P rabbit polyclonal sera (5940L) at a dilution of 1 ug/ml. The blot was visualized with a donkey anti-rabbit Ig coupled to HRP (Jackson ImmunoResearch Laboratories, Westgrove, Pa.) followed by incubation in ECL substrate.

For flow cytometry analysis, cells were collected and washed with ice cold staining buffer (PBS+1% BSA+Azide). The cells were then incubated for 30 minutes on ice with anti-L985P peptide polyclonal sera (5940L) at a 1 ug/ml concentration. The cells were washed 2 times with staining buffer and then incubated with a 1:100 dilution of a goat anti-rabbit Ig(H+L)-FITC reagent (Southern Biotechnology Associates, Inc., Birmingham, Ala.) for 30 minutes on ice. Following 2 washes, the cells were resuspended in staining buffer containing Propidium Iodide (PI), a vital stain that allows for identification of permeable cells, and analyzed by flow cytometry.

Using a rabbit polyclonal sera raised against a L985P peptide in a flow cytometric assay, L985P Gly 119 was detected on the cell surface of HEK cells transfected with L985P as described above. These antibodies also detected the presense of L985P in HEK-L985P lysates by Western analysis.

EXAMPLE 34

Generation of Mouse Monoclonal Antibodies to L552S Recombinant Protein

This example describes the generation of mouse monoclonal antibodies specific for the lung tumor antigen, L552S. These data show that L552 is immunogenic and support its use to generate B cell immune responses in vivo. Further, the antibodies generated herein can be used in diagnostic and passive immunotherapeutic applications.

Production and purification of proteins used for antibody generation: E. coli expressing recombinant L552S protein were grown overnight in LB Broth with the appropriate antibiotics at 37° C. in a shaking incubator. The next morning, 10 ml of the overnight culture was added to 500 ml of 2×YT plus appropriate antibiotics in a 2L-baffled Erlenmeyer flask. When the optical density (at 560 nanometers) of the culture reached 0.4-0.6, the cells were induced with IPTG (1 mM). Four hours after induction with IPTG the cells were harvested by centrifugation. The cells were then washed with phosphate buffered saline and centrifuged again. The supernatant was discarded and the cells were either frozen for future use or immediately processed. Twenty milliliters of lysis buffer was added to the cell pellets and vortexed. To lyse the E. coli cells, this mixture was then run through the French Press at a pressure of 16,000 psi. The cells were then centrifuged again and the supernatant and pellet were checked by SDS-PAGE for the partitioning of the recombinant protein. For proteins that localized to the cell pellet, the pellet was resuspended in 10 mM Tris pH 8.0, 1% CHAPS and the inclusion body pellet was washed and centrifuged again. This procedure was repeated twice more.

The washed inclusion body pellet was solubilized with either 8 M urea or 6 M guanidine HCl containing 10 mM Tris pH 8.0 plus 10 mM imidazole. The solubilized protein was added to 5 ml of nickel-chelate resin (Qiagen) and incubated for 45 min to 1 hour at room temperature with continuous agitation. After incubation, the resin and protein mixture were poured through a disposable column and the flow through was collected. The column was then washed with 10-20 column volumes of the solubilization buffer. The antigen was then eluted from the column using 8M urea, 10 mM Tris pH 8.0 and 300 mM imidazole and collected in 3 ml fractions. A SDS-PAGE gel was run to determine which fractions to pool for further purification. As a final purification step, a strong anion exchange resin such as Hi-Prep Q (Biorad) was equilibrated with the appropriate buffer and the pooled fractions from above were loaded onto the column. Each antigen was eluted off of the column with an increasing salt gradient. Fractions were collected as the column was run and another SDS-PAGE gel was run to determine which fractions from the column to pool. The pooled fractions were dialyzed against 10 mM Tris pH 8.0. This material was then submitted to Quality Control for final release. The release criteria were purity as determined by SDS-PAGE or HPLC, concentration as determined by Lowry assay or Amino Acid Analysis, identity as determined by amino terminal protein sequence, and endotoxin level was determined by the Limulus (LAL) assay.

The protein was then vialed after filtration through a 0.22-micron filter and the antigens were frozen until needed for immunization.

To generate anti-L552S mouse monoclonal antibodies, mice were immunized IP with 50 micrograms of recombinant L552S protein that had been mixed to form an emulsion with an equal volume of Complete Freund's Adjuvant (CFA). Every three weeks animals were injected IP with 50 micrograms of recombinant L552S protein that had been mixed with an equal volume of IFA to form an emulsion. After the fourth injection, spleens were isolated and standard hybridoma fusion procedures were used to generate anti-L552S mouse monoclonal antibodies.

Anti-L552S monoclonal antibodies were screened by ELISA analysis using the bacterially expressed recombinant L552S protein as follows. 96 well plates were coated with antigen by incubating with 50 microliters (typically 1 microgram) at 4° C. for 20 hours. 250 microliters of BSA blocking buffer was added to the wells and incubated at RT for 2 hours. Plates were washed 6 times with PBS/0.01% tween. Fifty microliters of each undiluted monoclonal supernatant were added per well and incubated at room temperature for 30 minutes. Plates were washed as described above before 50 microliters of goat anti-mouse horse radish peroxidase (HRP) at a 1:10000 dilution was added and incubated at RT for 30 minutes. Plates were washed as described above and 100 µl of TMB Microwell Peroxidase Substrate was added to each well. Following a 15 minutes incubation in the dark at room temperature the colorimetric reaction was stopped with 100 µl 1N H2SO4 and read immediately at 450 nm. A list of the mouse anti-L552S monoclonal antibodies that were generated, as well as their reactivity in an ELISA assay and Western blot are shown in Table 28. For Western blot analysis, recombinant L552S protein was diluted with SDS-PAGE loading buffer containing beta-mercaptoethanol, then boiled for 10 minutes prior to loading the SDS-PAGE gel. Protein was transferred to nitrocellulose and probed with each of the anti-L552S hybridoma supernatants. Anti-mouse-HRP was used to visualize the anti-L552S reactive bands by incubation in ECL substrate.

TABLE 28

ELISA and Western Blot Analysis of L552S Monoclonal Antibodies

| L552S Mouse Monoclonal Supernatant | Protein Tested | | |
|---|---|---|---|
| | ELISA | | Western Blot |
| | L552S | L773PA | L552S |
| 175C11 | + | − | + |
| 175C30 | − | − | − |
| 175C63 | + | − | − |
| 175C89 | + | + | − |
| 175D3 | + | − | + |
| 175D4 | + | − | + |
| 175D5 | + | − | + |
| 175D7 | + | − | + |
| 175D9 | + | + | + |
| 175D12 | + | − | + |
| 175D14 | + | − | + |
| 175D21 | + | − | + |
| 175D31 | + | − | + |
| 175D36 | + | − | + |
| 175D37 | + | − | + |
| 175C11-1 | + | ND | + |
| 175C11-2 | + | ND | + |
| 175C11-3 | + | ND | + |
| 175C11-4 | + | ND | + |
| 175D12-1 | + | ND | + |
| 175D12-2 | + | ND | + |

TABLE 28-continued

ELISA and Western Blot Analysis of L552S Monoclonal Antibodies

| L552S Mouse Monoclonal Supernatant | Protein Tested | | |
|---|---|---|---|
| | ELISA | | Western Blot |
| | L552S | L773PA | L552S |
| 175D12-3 | + | ND | + |
| 175D12-4 | + | ND | + |
| 175D21-1 | + | ND | + |
| 175D21-2 | + | ND | + |
| 175D21-3 | + | ND | + |
| 175D21-4 | + | ND | + |

ND: not determined

The data described in the above example show that L552 is immunogenic and can be used to generate B cell immune responses in vivo. Further, the antibodies generated herein have utility in diagnostic and passive immunotherapeutic applications.

EXAMPLE 35

Generation of L552S-Specific T Cells and Identification of L552S T Cell Epitopes Described herein is the identification of specific epitopes recognized by L552S antigen-specific T cells. These experiments support the fact that the L552S protein is immunogenic and support its use as a target for vaccines and immunotherapeutics.

A pool of 20-mer peptides, overlapping by 15 amino acids, that span the entire amino acid sequence of L552S (full length amino acid sequence of L552S provided in SEQ ID NO:809) was used in in vitro culture with T cells derived from normal donor PBMC to expand CD4 and CD8 T cells. The amino acid sequence of each of the thirty 20-mer peptides and the respective DNA sequence which encodes each of these peptides is provided in Table 25 and described in Example 27. Cultures were established from multiple donors and T cell responses were monitored following successive in vitro stimulations. L552S-specific T cell responses were detected in 3 of 5 normal donors. Given that a number of tumor antigens are identified for each tumor type that are reasonable vaccine candidates, this methodology can be used to compare the antigen-specific T cell frequency of different antigens.

T cell lines were generated from normal donor PBMCs. The source of T cells was from the CD69 negative population of PBMCs that had been precultured for 1-2 days. Several different priming conditions were evaluated to identify the most efficient method. These conditions are summarized in Table 29. In all assays, the T cells were initially primed with one of the conditions described in Table 29, plus IL-12 for 2-3 days. 11-2 and IL-7 were then added to the cultures which were further cultured for one week. The cultures were then restimulated 2 or 3 times with PBMCs pulsed with the entire pool of overlapping L552S peptides. The cells were collected following the last restimulation and analyzed for antigen-specificity using an IFN-γ solubilized ELISPOT assay. As shown in Table 29, priming cultures with peptide pulsed dendritic cells (DCs) was the most effective for generating antigen-specific T cell lines, either in 96 well or 24 well plates.

TABLE 29

Conditions used to prime donor T cells with L552S overlapping peptides.

Condition:

| A | Peptide-pulsed PMBCs/irradiated (overnight pulse, irradiated 11 minutes) |
|---|---|
| B | Peptide-pulsed DCs/irradiated (overnight pulse, irradiated 11 minutes) |
| C | Peptide-pulsed PBMCs/fixed (overnight pulse, 30 second PFA fix) |
| D | Peptide-pulsed PBMCs/mitomycin C-treated 30 minutes (overnight pulse) |

| Experiment: | Condition (type of plate) | | | Assay (solubilized ELISPOT) | |
|---|---|---|---|---|---|
| | Prime | Simulation 1 | Stimulation 2-3 | Target Cells | T cell response |
| I | A (96U) | A (96U) | A (24F) | D (96U) | + |
| II | B (96U) | A (96U) | A (24F) | D (96U) | +++ |
| III | C (96U) | C (96U) | C (96U) | C (96U) | − |
| IV | B (24F) | A (24F) | A (24F) | D (96U) | +++ |

Abreviations:
96U: 96 well, U-bottomed plates;
24F: 24 well, flat-bottomed plates.

Further analysis of the T cell lines generated as described above showed that these lines generally recognized target cells pulsed with whole protein antigen as well as peptides. This suggests that at least some of the T cell epitopes identified are naturally processed. The L552S T cell lines generated from donor D35, did not, however, recognize target cells pulsed with whole protein antigen. Additional analysis using anti-MHC Class I and Class II antibodies showed that, while some of the T cell response was MHC class I restricted (CD8+ T cell-mediated), most of the T cell response generated using this method was MHC class II restricted, and thus mediated by CD4+ T cells.

Following the generation of the T cell lines using a pool of overlapping peptides spanning the entire L552S molecule, target cells pulsed with pools of fewer peptides breaking the L552S into smaller regions were then used to further map the epitopes recognized by the line generated from donor D369. These experiments showed that the T cells recognized a region of L552S within peptides 19-24. The epitope was further mapped to peptide 20 (amino acid sequence set forth in SEQ ID NOs:1964 and 2005; DNA sequence encoding peptide 20 set forth in SEQ ID NO:1993) by using individual peptide-pulsed target cells. Additional epitope mapping of the T cell line generated from donor D35 showed that T cells from this donor recognized an epitope within peptides 22-24 (amino acid sequence of the overlapping peptide of 22-24 is set forth in SEQ ID NO:2008; individual 20-mer peptides of 22-24 are provided in Table 25). Table 30 summarizes the epitope mapping analysis using different conditions described in Table 29.

TABLE 30

Summary of L552S Epitope Analysis

| Donor-Condition: | Peptide Pool | | | | | | | | | |
|---|---|---|---|---|---|---|---|---|---|---|
| | 1-3 | 4-6 | 7-9 | 10-12 | 13-15 | 16-18 | 19-21 | 22-24 | 25-27 | 28-29 |
| D446-II | | + | | | | + | + | + | | |
| D446-I | | | | | | | + | + | | |
| D35-I | | | | | | + | + | ++ | | |
| D369-II | | | | | | | + (peptide 20) | | | |

In an additional study, donor D446 was further evaluated for T cell responses against 2 other lung-specific antigens in addition to L552S. T cell lines were generated and epitopes identified from donor D446 using overlapping peptides for all three lung-specific antigens. This experiment demonstrated that a single donor can have T cell responses to multiple antigens, including L552S. In a related study, 3 different donors were analyzed for their T cell response to the same lung-specific antigen. All three donors recognized different epitopes of this antigen. Therefore, these data support the use of multiple epitopes from multiple lung tumor antigens, including L552S, in vaccine strategies for lung cancers.

In summary, a peptide pool of overlapping 20-mer peptides spanning the entire L552S protein were used to generate T cell lines and to map T cell epitopes recognized by these lines. Most, but not all, the T cell lines also recognized whole protein pulsed target cells suggesting that at least some of the epitopes are naturally processed. Furthermore, the responses to targets pulsed with pooled or individual peptides were equal or higher than those to target cells pulsed with whole protein showing that this technique is more sensitive for detecting immune responses. Moreover, this technique can be used for all individuals, regardless of their HLA type. An additional advantage of this approach to evaluating T cell responses to lung-specific antigens is responses to *E. coli* and viral antigens is avoided. Given that a number of tumor antigens can be identified for each tumor type that are attractive vaccine candidates, this methodology can be used to compare the antigen-specific T cell frequency of different antigens. Finally, the experiments described above further confirm that the L552S lung tumor antigen is immunogenic and support its use as a target for vaccine and immunotherapies.

EXAMPLE 36

Induction of L984P-Specific CD8+ T Cells and Identification of L984P T Cell Epitopes This example describes the in vitro generation of CD8+ T cells specific for the lung tumor angien, L984P, and the identification of the specific, naturally processed epitopes recognized by these T cells, using the methods essentially as described above in Example 35. These experiments further demonstrate that L984P is immunogenic and support its use as a target for vaccines and other immunotherapies.

A pool of 20-mer peptides, overlapping by 10 amino acids, that span the entire amino acid sequence of L984P (full-length amino acid sequence of L984P provided in SEQ ID NO:1869) were synthesized. Due to the difficulty in synthesizing the glutamine (Q) repeat of the L984P protein, the first 10 glutamine residues of this region were not included in the overlapping peptides. The L984P peptides and overlapping peptides from 3 other lung tumor antigens were mixed into one "super peptide pool". This super pool was used to pulse autologous DCs which were then used to stimulate T cells derived from normal donor PBMC (donor D366). Following 3 rounds of stimulation, analysis of IFNγ production showed that the highest responses were seen to L984P with lower responses observed to the other three antigen pools. After 5 rounds of stimulation, the difference in responses between L984P and the other lung tumor antigens was even more pronounced, indicating preferential expansion of the L984P-specific T cells over time in vitro using this super peptide pool.

T cell responses from two additional donors (D223 and D446) were then analyzed. This experiment indicated that different epitopes of the L984P protein were recognized in the three donors. D223 T cells produced IFNγ in response to stimulation with pool C of L984P, D366 in response to pool A and D446 in response to pool B. Flow cytometric analysis indicated that the vast majority of the expanded T cells from D223, D366, and D446 were CD8+ (84%, 64%, and 67%, respectively; CD4+ T cell percentages were 7%, 5%, and 1.7%, respectively). Addition of anti-MHC class I blocking antibodies to the cultures followed by analysis of IFNγ production confirmed that the responses were largely MHC class I restricted and mediated by CD8+ T cells.

Further analysis of the L984P-specific CD8+ T cells from D336 mapped the epitope recognized in this donor to pool A, peptide #3 (amino acid sequence set forth in SEQ ID NO:2011). Similar analysis in donor 223 mapped the epitope to peptide #17 (amino acid sequence set forth in SEQ ID NO:2010). Responses to L984P protein loaded DCs were also observed although, they were lower than the response to peptide pulsed PBMC/DC. This suggests that at least some of the epitopes identified are naturally processed. Thus, these experiments further demonstrate that L984P is immunogenic and support its use as a target for vaccines and immunotherapies. Furthermore, these studies defined illustrative naturally processed peptide epitopes of the L984P tumor antigen that may be used in such strategies.

EXAMPLE 37

Identification of Naturally Processed L978P-Derived CD4+ T Cell Epitopes

This example describes the in vitro generation of CD4+ T cells specific for the lung tumor angien, L978P, and the identification of the specific, naturally processed epitopes recognized by these T cells. These experiments demonstrate the presence of CD4+ T cells specific for L978P in PBMC, supporting its use as a target for vaccines and other immunotherapies.

A total of 92 20-mers overlapping by 15 amino acids were generated. The amino acid sequences of these peptides are provided in SEQ ID NOs:2012-2103. In order to determine which peptides were immunogenic, dendritic cells (DCs) were derived from the PBMC of a normal male donor using culture with GMCSF and IL-4 by standard protocol. CD4+ T cells were isolated from the same donor using MACS beads and negative selection.

Two pools of 46 20-mers were made: Pool 1 covered the N-terminal half of L978 (amino acids 1-254) and Pool 2 covered the C terminal half of L978 (amino acids 230-474). DCs were pulsed overnight with one of the two-peptide pools, at a final concentration of 250 ng/ml/peptide. The pulsed DCs were washed and plated at 1×10⁴ cells/well in 96-well round-bottomed plates, and 1×10⁵ purified CD4+ T cells were added to each well. The cell cultures were supplemented with 60 ng/ml IL-6 and 10 ng/ml IL-12, and incubated at 37° C. The cultures were re-stimulated as above on a weekly basis using peptide pulsed DCs as antigen presenting cells (APCs). Re-stimulated cultures were supplemented with 5 ng/ml of IL-7 and 10 U/ml IL-2. Following 4 in vitro stimulation cycles, the cultures from each well (each well representing an independent T cell line) were tested for specific proliferation and IFN-γ production in response to the stimulating peptide pools versus the other pool of L978 peptides.

83/288 lines stimulated with peptide Pool 1 demonstrated specific proliferation (as measured using a standard $H^3$ incorporation assay) and cytokine production (as measured using an ELISA specific for IFN-γ), with activity greater than three times background in both assays. Fourty-six of these lines showed proliferation activity greater than 25 times background. 51/288 lines stimulated with peptide Pool 2 demonstrated specific proliferation (as measured using a standard $H^3$ incorporation assay) and cytokine production (as measured using an ELISA specific for IFN-γ), with activity greater than three times background in both assays. Twenty-four of these lines showed proliferation activity greater than 25 times background. All lines that showed proliferation responses that were at least 25 times higher than background, and a cytokine response of at least 3 times higher than background were further analyzed for protein specificity.

Seventy lines were tested for reactivity towards lysates of tumor cell lines that have been shown to express L978. By real-time PCR it has been shown that L978 is highly expressed in the tumor cell lines H69 and DMS79, but not in HTB183. Three of these lines were stimulated with Peptide Pool 1: 1AH8, 1BA4, 1BF8, and two these lines were stimulated with Peptide Pool 2: 2BA4, 2BG7. Each of these lines was tested against each of the individual peptides from their stimulating pool to determine the reactive epitopes.

Line 1AH8 responded to peptides #13 and #14 with the sequences RPMNAFMVWSQIERRKIMEQ (SEQ ID NO: 2024) and FMVWSQIERRKIMEQSPDM (SEQ ID NO:2025), which contain the shared amino acid sequence FMVWSQIERRKIMEQ (SEQ ID NO:2104, with the corresponding DNA sequence disclosed in SEQ ID NO:2105). SEQ ID NO:2104 corresponds to amino acid residues 66-80 of L978P (SEQ ID NO:1812). In addition, Line 1AH8 responded to peptides #20, #21, and #22, with the sequences RWKLLKDSDKIPFIREAERL (SEQ ID NO:2031), KDSDKIPFIREAERLRLKHM (SEQ ID NO:2032), and IPFIREAERLRLKHMADYPD (SEQ ID NO:2033), which contain the shared amino acid sequence IPFIREAERL (SEQ ID NO:2106, with the corresponding DNA sequence disclosed in SEQ ID NO:2107). SEQ ID NO:2106 corresponds to amino acids 106-115 of L978P (SEQ ID NO:1812). Re-expansion of 1AH8 on pools of either peptides 13-14 or 20-22 resulted in expansion of T cells only in response to the 20-22 pool.

Line 1BA4 responded to peptides #14 and #15 with the sequences FMVWSQIERRKIMEQSPDM (SEQ ID NO:2025) and QIERRKIMEQSPDMHNAEIS (SEQ ID NO:2026), which contain the shared amino acid sequence QIERRKIMEQSPDM (SEQ ID NO:2108), with the corresponding DNA sequence disclosed in SEQ ID NO:2109). SEQ ID NO:2108 corresponds to amino acids 71-84 of L978P (SEQ ID NO:1812).

Line 1BF8 responded to peptides #11 and #12 with the sequences WCKTPSGHIKRPMNAFMVWS (SEQ ID NO:2022) and SGHIKRPMNAFMVWSQIERR (SEQ ID NO:2023), which contain the shared amino acid sequence SGHIKRPMNAFMVWS (SEQ ID NO:2110), with the corresponding DNA sequence disclosed in SEQ ID NO:2111. SEQ ID NO:2110 corresponds to amino acid residues 56-70 of L978P (SEQ ID NO:1812). In addition, line 1BF8 also responded to peptides #17, #18, and #19 with the sequences SPDMHNAEISKRLGKRWKLL (SEQ ID NO:2028), NAEISKRLGKRWKLLKDSDK (SEQ ID NO:2029), and KRLGKRWKLLKDSDKIPFIR (SEQ ID NO:2030), which contain the shared amino acid sequence KRLGKRWKLL (SEQ ID NO:2112), the corresponding DNA sequence of which is disclosed in SEQ ID NO:2113. SEQ ID NO:2112 corresponds to amino acids 91-100 of L978P (SEQ ID NO:1812).

Line 2BA4 responded to peptides #91 and #92 with the sequences TPEVSEMISGDWLESSISNL (SEQ ID NO:2102) and SEMISGDWLESSISNLVFTY (SEQ ID NO:2103), which contain the shared amino acids sequence SEMISGDWLESSISNL (SEQ ID NO:2114), with the corresponding DNA sequence disclosed in SEQ ID NO:2115. SEQ ID NO:2114 corresponds to amino acid 455-470 of L978P (SEQ ID NO:1812).

Line 2BG7 responded to peptides #83 and #84 with the sequences SSNFESMSLGSFSSSSALDR (SEQ ID NO:2094) and SMSLGSFSSSSALDRDLDFN (SEQ ID NO:2095), which contain the shared amino acid sequence SMSLGSFSSSSALDR (SEQ ID NO:2116), with the corresponding DNA sequence disclosed in SEQ ID NO:2117. SEQ ID NO:2116 corresponds to amino aicds 416-430 of L978P (SEQ ID NO:1812).

The minimal epitopes for each of these lines are contained within the shared amino acid sequence. Each line was re-stimulated with a pool of 2-3 peptides that contained the corresponding minimal epitopes. The T cell lines were tested for their ability to recognize their stimulating peptide, and additionally against two L978P protein sources, L978P expressing tumor cell lysates and lysates of L978P-adenovirally infected VA13 cells to determine if they responded to a naturally processed epitope.

Line 1AH8 proliferated and produced IFN-γ in response to its stimulating peptide pool, peptides p20-p22 (SEQ ID NOs: 2031, 2032, and 2033, and L978P expressing small cell lung tumor cell lines H69 and DMS79, but not in response to the control peptide pool, or a lung tumor cell line that does not express L978P. These results demonstrate that the L978P-derived epitopes recognized by line 1AH8 can be naturally processed from tumor derived L978P and presented to CD4 T cells by APC.

Line 2BA4 proliferated and produced IFN-γ in response to its stimulating peptide pool, peptides p91-p92 (SEQ ID NOs: 2102 and 2103), and L978P expressing small cell lung tumor cell lines H69 and DMS79, but not in response to the control peptide pool, or a lung tumor cell line that does not express L978P. These results demonstrate that the L978P-derived epitopes recognized by line 2BA4 can be naturally processed from tumor derived L978P and presented to CD4 T cells by APC.

Line 1BF8 proliferated and produced IFN-γ in response to its stimulating peptide pool, peptides p91-92 (SEQ ID NOs: 2102 and 2103), but not in response to L978P expressing small cell lung tumor cell lines H69 and DMS79, to the control peptide pool, or a lung tumor cell line that does not express L978P. These results demonstrate that the L978P-derived epitopes recognized by line 2BA4 cannot be naturally processed from tumor- or adenovirus-derived L978P and presented to CD4 T cells by APC. Line 1AH8 epitoope p13-14 (SEQ ID NO:2104) and Line 2BG7 epitope p83-84 (SEQ ID NO:2116) responded only to their stimulating peptides, indicating that these are not naturally processed epitopes.

Line 1B4A4 epitope p14-15 (SEQ ID NO:2108), Line 1BF8 epitope p11-12 (SEQ ID NO:2110), and Line 1BF8 epitope p17-19 (SEQ ID NO:2112) proliferated and produced IFN-γ in response to their stimulating peptide pool and L978P-adenovirus VA13 lysates, but not in response to the control peptide pool, control adenovirus lysate or lung tumor lysate, indicating that these T cells recognized a naturally processed epitope that can be processed from L978P protein produced by recombinant adenovirus but may not be processed from L978P expressed by lung tumors.

To determine the HLA restriction of the L978P responses for 1A-H8 (p20-22) and 2B-A4 (p91-92), the two T cell lines that could specifically recognize lysates from L978P-expressing tumors, a panel of antigen presenting cells (APC) was generated that partially matched with the donors used to generate the T cell lines (Table 31). The APC were pulsed with the corresponding specific peptides and used in proliferation and cytokine assays together with L978P specific lines.

The HLA mismatch analysis demonstrated that for both lines 1A-H8 and 2B-A4, the restricting allele was the HLA-DRB*0101 allele, since only APC that expressed this allele could present the corresponding peptides to each of the T cell lines. Lines 1A-H8 p20-22 and 2B-A4 p91-92 responded to donors containing this allele by proliferation and production of IFN-γ, as determined by ELISA.

EXAMPLE 38

Identification of Antibodies Recognizing Tum or Associated Antigen 1978P Peptide Specific Antigenic Epitopes in Biological Samples from Patients with Lung Cancer Peptide-array screening was performed to evaluate biological samples (e.g., serum and lung plural effusion fluid) obtained from patients with cancer for the presence of antibodies recognizing the lung tumor-associated antigen (TA-antigen) referred to as L978P. The data disclosed indicate that TA-antigens (e.g., L978P) are immunogenic and that peptides derived therefrom, which contain TA-antigen specific antigenic epitopes, may be used in a variety of diagnostic, prognostic and/or therapeutic methods for cancer, including the development of a cancer vaccine.

Peptide-array screening offers several advantages over other assay methods. Such advantages include the lack of non-specific background signal and the ability to screen biological samples without needing recombinant TA-antigen. For example, a background of E. coli host cell proteins derived from the purification of recombinant TA-antigen may be detected by antibodies that are naturally present in a biological sample obtained from a cancer patient or a normal donor. The presence of antibodies recognizing one or more E. coli proteins (i.e., TA-antigen non-specific background) may negatively impact the sensitivity of a diagnostic method intended to detect a patient's antibodies that specifically recognize one or more TA-antigens. The synthetic peptide compositions used in peptide-array screening are not subject to such non-specific background signal. Accordingly, peptide-array screening, as disclosed herein, was used to characterize a patient's antibodies (repertoire) recognizing TA-antigen epitopes based on antibody specificity, sensitivity (intensity) and clonality.

In order to characterize a lung cancer patient's antibodies recognizing the TA-antigen L978P, and at the same time circumventing the need for preparing recombinant L978P, a series of 93 consecutive overlapping synthetic peptides (20 amino acids in length and overlapping by 15 amino acids) were prepared spanning the entire 474 amino acid length of L978P (as set forth in SEQ ID NO:1812). The amino acid sequence of these peptides is provided in SEQ ID NOs: 2012-2103. Each peptide was dispersed into individual wells of a multiwell plate and incubated with, for example, a lung plural effusion fluid sample obtained from a lung cancer patient. Signal was generated from an ELISA and used to detect the presence of an antibody recognizing a specific L978P peptide. The results from this peptide-array screen clearly indicated that antibodies contained in a lung effusion fluid sample obtained from patient number 12 recognized L978P peptide numbers 60, 85 and 86 (SEQ ID NOs:2071, 2096, and 2097; signal-to-noise ratio (S/N-ratio) greater than 5). The amino acid sequence of peptide number 85, for example, is SFSSS-SALDRDLDFNFEPGS, as set forth by SEQ ID NO:2096. All other L978P peptides in the peptide-array were either not detected or detected at an S/N-ratio less than 5. Similarly, lung plural effusion fluid obtained from patient number 290 contained L978P antibodies capable of detecting L978P peptide number 72 with an S/N-ratio greater than 5, all other peptides were either not detected or detected at an S/N-ration less than 5.

In another study, antibodies recognizing L978P antigenic epitopes present in serum samples obtained from lung cancer patients were characterized by L978P peptide-array screening. With S/N-ratios greater than 5, patient serum sample number 6 detected an L978P antigenic epitope contained in peptide number 14 (SEQ ID NO:2025); similarly, patient serum sample number 11 detected peptide numbers 4 and 65 (SEQ ID NOs:2015 and 2076), patient serum sample number 7 detected peptide numbers 10 and 25 (SEQ ID NOs:2021 and 2036), and patient serum sample number 12 detected peptides 4 and 65 (SEQ ID NOs:2015 and 2076). In each case, all other L978P peptides in the array were either not detected or detected at S/N-ratios less than 5. A total of 50 serum samples from patients with lung cancer were evaluated in this study, the data are summarized in Table 31.

TABLE 31

L978P Peptide-array screening of serum samples obtained from lung cancer patients.

| Patient Serum Sample Number | L978P Peptide Number Detected (SEQ ID NO) |
|---|---|
| 1 | no peptide detected |
| 2 | no peptide detected |
| 3 | no peptide detected |

TABLE 31-continued

L978P Peptide-array screening of serum
samples obtained from lung cancer patients.

| Patient Serum Sample Number | L978P Peptide Number Detected (SEQ ID NO) |
|---|---|
| 4 | no peptide detected |
| 5 | no peptide detected |
| 6 | 14 (2025) |
| 7 | 10, 25 (2021, 2036) |
| 8 | no peptide detected |
| 9 | no peptide detected |
| 10 | no peptide detected |
| 11 | 4, 65 (2015, 2076) |
| 12 | 4, 65 (2015, 2076) |
| 13 | 26 (2037) |
| 14 | 26, 48 (2037, 2059) |
| 15 | no peptide detected |
| 16 | no peptide detected |
| 17 | no peptide detected |
| 18 | no peptide detected |
| 19 | 4, 65 (2015, 2076) |
| 20 | 4, 65 (2015, 2076) |
| 21 | no peptide detected |
| 22 | no peptide detected |
| 23 | 2 (2013) |
| 24 | no peptide detected |
| 25 | no peptide detected |
| 26 | no peptide detected |
| 27 | no peptide detected |
| 28 | no peptide detected |
| 29 | 50 (2061) |
| 30 | no peptide detected |
| 31 | 65 (2076) |
| 32 | no peptide detected |
| 33 | no peptide detected |
| 34 | 65 (2076) |
| 35 | 58 (2069) |
| 36 | 58, 71 (2069, 2082) |
| 37 | no peptide detected |
| 38 | no peptide detected |
| 39 | no peptide detected |
| 40 | 1, 62, 89 (2012, 2073, 2100) |
| 41 | no peptide detected |
| 42 | no peptide detected |
| 43 | no peptide detected |
| 44 | no peptide detected |
| 45 | 17 (2028) |
| 46 | no peptide detected |
| 47 | 24, 26, 36 (2035, 2037, 2047) |
| 48 | no peptide detected |
| 49 | no peptide detected |
| 50 | no peptide detected |

According to the study presented in Table 32, 32% of the serum samples obtained from patients with lung cancer contained antibodies capable of recognizing one or more L978P peptides. Antibodies recognizing antigenic epitopes contained in certain L978P peptides (e.g., numbers 4, 26, 58 and 65) were detected in serum samples obtained from more than one patient and therefore may represent frequently recognized antigenic epitopes. The amino acid sequence of L978P peptide number 4 is AGESSDSGAGLELGIA-SSPT (SEQ ID NO:2015), corresponding to amino acids 16-35 of SEQ ID NO:1812. The amino acid sequence of L978P peptide number 28 is SGNANSSSSAAASSKPGEKG (SEQ ID NO:2039), corresponding to amino acids 136-155 of SEQ ID NO:1812. The amino acid sequence of L978P peptide number 56 is SASAALAAPGKHLAEKKVKR (SEQ ID NO:2067), corresponding to amino acids 276-295 of SEQ ID NO:1812. The amino acid sequence of L978P peptide number 65 is PLGLYEEEGAGCSPDAPSLS (SEQ ID NO:2076), corresponding to amino acids 321-340 of SEQ ID NO:1812.

Peptides detected according to this procedure were used to search the GenBank protein database for homology with other proteins. Accordingly, the SRY (sex determining region Y)-box 4 protein (GenBank Accession number NM 003107) and the mouse SOX-4 protein were shown to share homology with L978P peptide 85 (SEQ ID NO:2096). No homology was found to other proteins of the SOX-family.

In yet another study, rabbits were immunized with L978P peptide number 85 (SEQ ID NO:2096). The corresponding rabbit immune serum was then characterized by L978P peptide-array screening and shown to contain antibodies recognizing epitopes contained in L978P peptides 85 and 86, and to a lesser extent 84. These data indicate, for example, that the immunogenic epitope of peptide 85 may overlap with an amino acid sequence contained in the contiguous overlapping peptide numbers 86 and 84. In this experiment, all other L978P peptides in the array were not detected.

In further experiments, Western transfer and immunoblot analysis was used to confirm that rabbit polyclonal antibodies recognizing L978P peptide 85 could also detect full-length L978P protein. To do this, protein (cell) extracts were prepared from two human lung tumor cell lines as well as HEK298 cells. The data from these experiments clearly indicated that polyclonal rabbit immune serum raised against L978P peptide number 85 contains antibodies capable of detecting a L978P protein of approximately 63 kDa, contained in the two lung tumor cell lines examined. The L978P signal detected was shown to be specific, as it was competed away when Western transfers were probed (i.e., immunoblotted) with rabbit anti-peptide 85 immune serum in the presence of L978P peptide number 85. No L978P was detected in extracts prepared from HEK298 cells, a cell line that is not a lung tumor cell line.

In conclusion, this example clearly demonstrates that peptide-array screening can be used to detect the presence of a patient's antibodies recognizing a TA-antigen (e.g., L987P), as well as to characterize such antibodies based on their specificity, intensity and clonality. The peptide-array screening method disclosed herein alleviates the need for recombinant TA-antigen, and is not subject to non-specific background that may occur when using a TA-antigen prepared from a recombinant expression system. Accordingly, peptide-array screening may be useful in a variety of diagnostic and/or therapeutic applications that may benefit a patient with, for example, lung cancer.

EXAMPLE 39

Identification of Antibodies Recognizing Tumor Associated Antigen L984P Peptide Specific Antigenic Epitopes in Biological Samples Obtained from Patients with Lung Cancer In Example 9, we described the molecular cloning of a cDNA encoding the full-length amino acid sequence of the lung tumor associated antigen (TA-antigen) referred to as L984P (SEQ ID NO:1813). In this Example, we disclose the use of peptide-array screening to detect antibodies recognizing specific TA-antigen L984P peptides present in biological samples (e.g., sera or lung plural effusion fluid), obtained from patients with lung cancer. Accordingly, peptide-array screening was used to characterize a cancer patient's antibody repertoire based on specificity, intensity (i.e., titer) and the pattern of L984P peptide epitopes recognized (i.e., clonality).

In a first study, Western transfers of purified recombinant L984P 6×his-tagged fusion protein were probed (i.e., immunoblotted) using lung effusion fluid samples obtained from lung cancer patient numbers 285 and 2. The lung effusion samples so evaluated were shown to contain antibodies capable of detecting recombinant L984P (30 kDa). In these experiments, nine lung plural effusion fluid samples obtained from lung cancer patients were evaluated by Western transfer and immunoblotting, four (i.e., 44%) of which detected recombinant L984P. In parallel, no lung effusion fluid sample obtained from 6 normal donors contained antibodies capable of detecting recombinant L984P. Similarly, in another study, Western transfer (immunoblot) experiments were performed using serum samples obtained from 50 patients with lung cancer. Of these 50 serum samples, 12 (i.e., 24%) contained antibodies capable of detecting recombinant L984P. In additional experiments, no L984P signal was detected from any one of 48 serum samples that were obtained from normal donors.

In order to characterize the repertoire of antibodies recognizing TA-antigen L984P antigenic epitopes, biological samples obtained from patients with lung cancer were characterized (according to specificity, intensity and clonality) by peptide-array screening for the presence of antibodies capable of recognizing specific L984P peptides. To do this, a consecutive series of 23 overlapping peptides spanning the full-length 238 amino acid sequence of L984P (SEQ ID NO:1813) were synthesized and dispensed into individual wells of a microtiter plate. The amino acid sequences of these peptides are set forth in SEQ ID NOs:2119-2141. Each well was then incubated with a biological sample (e.g., serum and lung plural effusion samples) obtained from patients with lung cancer. An ELISA was used to detect the presence of antibodies recognizing a specific L984P peptide. In this peptide-array analysis, the serum sample obtained from lung cancer patient number 2 recognized L984P peptide number 2 (SEQ ID NO:2120). Patient serum sample number 27 recognized L984P peptide numbers 2 and 9. The amino acid sequence of peptide number 9 (SEQ ID NO:2127). The serum sample obtained from patient number 50 detected L984P peptide number 2. The serum sample obtained from patient number 21 detected L984P peptide numbers 2, 10, 23 and 24. The amino acid sequence of these peptides may be determined by inspection of the full-length amino acid sequence of SEQ ID NO:1813, in the context that sequential overlapping peptides are 20 amino acids in length overlapping by 10 amino acids. In addition, the amino acid sequences of these peptides is set forth in SEQ ID NOs: 2120, 2128, 2141, and 2142, respectively. In these experiments, all other peptides in the array were either not or only weakly detected.

Peptide-array analysis was also used to evaluate a patient's repertoire (i.e., clonality) of antibodies that may recognize a pattern of TA-antigen specific peptides. In this context, for example, antibodies contained in the serum sample from patient number 2 appear to be monoclonal in profile (detecting only peptide number 2 (SEQ ID NO:2120)), while the sample obtained from patient number 27 recognizes a pattern of peptides that is polyclonal, detecting non-contiguous peptides 2 and 9 (SEQ ID NOs:2120 and 2127). Similarly, patient sample number 21 also appears to be polyclonal, recognizing non-contiguous epitopes contained by peptides 2, 10 and 23/24 (SEQ ID NOs:2120, 2128, 2141, and 2142). Accordingly, the clonality of antigenic epitopes recognized by antibodies obtained from a patient having cancer can be used to monitor the progression of cancer, before, during and/or after treatment.

In another study, polyclonal antibodies were prepared from rabbits immunized with recombinant L984P. Immune serum prepared from L984P immunized rabbits was then characterized by L984P peptide-array screening. Antibodies contained in this rabbit polyclonal immune serum recognized L984P peptides 1, 2, 7, 8, 21 and 22 (SEQ ID NOs:2119, 2120, 2125, 2126, 2139, and 2140); other L984P peptides were either not or only weakly detected.

In conclusion, this Example demonstrates that peptide-array analysis may be used to characterize a patient's antibodies to a TA-antigen, for example the lung TA-antigen L984P, based on specificity, intensity and clonality. Peptide-array screening may be useful in a variety of diagnostic, prognostic and/or therapeutic methods for lung cancer. For example, the clonality of a patient's antibody repertoire may be used to monitor or otherwise characterize a patient's specific immune response to one or more TA-antigens. The clonality of a patient's antibody response may also be used to monitor tumor progression before, during and/or after treatment of a cancer, such as lung cancer.

EXAMPLE 40

Screening for Lung Cancer Using Multiple TA-Antigens

As disclosed herein, we have identified tumor-associated antigens (TA-antigens) that are overexpressed in lung cancer patients. In addition, we disclosed in Examples 38 and 39 that biological samples (e.g., serum and lung plural effusion fluid) obtained from a patient with lung cancer contain antibodies recognizing antigenic epitopes contained in a TA-antigen, as determined by peptide-array and/or analysis of full-length proteins. We also disclosed that peptide-array screening may be used to determine whether an individual does or does not have lung cancer and to monitor the progression of cancer before, during and after treatment. Further still, we disclosed in Examples 38 and 39, that peptide-array screening may be used to characterize a patient's antibodies recognizing one or more TA-antigen antigenic epitopes based on specificity, intensity and clonality.

Accumulatively, the data disclosed herein indicate that antibodies in an individual patient with cancer, for example a lung cancer patient, may recognize one but not another TA-antigen, because that that particular tumor apparently expresses one but not the other TA-antigen in a manner that is capable of eliciting an immune response in that patient. It would be beneficial to format a screening method, using multiple TA-antigens that would detect a higher percentage of cancers than a correspondingly similar method using only one TA-antigen. Accordingly, in this example, we disclose that at least 60% of biological samples obtained from lung cancer patients can be detected by multi TA-antigen screening methods, whereas, individually each TA-antigen identifies a patient with lung cancer in 24-32% of the samples tested.

In this Example, serum samples obtained from fifty lung cancer patients were screened against three lung TA-antigens, L978P, L984P and NY-ESO-1. In this composite analysis, antibodies recognizing TA-antigens L984P and NY-ESO-1 were detected using recombinant protein, while the presence of antibodies recognizing TA-antigen L978P was detected using peptide-array screening. The data are summarized in Table 32.

TABLE 32

| Patient Number | L978P | L984P | NY-ESO-1 |
|---|---|---|---|
| 1 | − | − | − |
| 2 | − | + | − |
| 3 | − | + | − |
| 4 | − | − | − |
| 5 | − | − | − |
| 6 | + | − | − |
| 7 | + | + | − |
| 8 | − | − | − |
| 9 | − | − | − |
| 10 | − | − | − |
| 11 | + | − | − |
| 12 | + | − | − |
| 13 | + | − | − |
| 14 | + | − | − |
| 15 | − | − | − |
| 16 | − | − | − |
| 17 | − | − | − |
| 18 | − | − | − |
| 19 | − | − | − |
| 20 | + | − | − |
| 21 | − | + | − |
| 22 | − | + | − |
| 23 | − | + | − |
| 24 | − | − | − |
| 25 | − | − | + |
| 26 | − | − | − |
| 27 | − | + | − |
| 28 | − | − | − |
| 29 | + | − | − |
| 30 | − | − | − |
| 31 | + | − | − |
| 32 | − | − | − |
| 33 | − | − | − |
| 34 | + | − | − |
| 35 | + | − | − |
| 36 | + | − | − |
| 37 | − | − | − |
| 38 | − | + | − |
| 39 | − | − | − |
| 40 | + | − | − |
| 41 | − | − | − |
| 42 | − | − | + |
| 43 | − | − | − |
| 44 | − | − | + |
| 45 | + | − | − |
| 46 | − | − | − |
| 47 | + | − | − |
| 48 | − | + | − |
| 49 | − | + | − |
| 50 | − | + | − |

Multiple TA-antigen (composite) screening, as disclosed in Table 32, clearly indicates that at least 54% of patients with lung cancer can be detected using a combination of L984P and L978P TA-antigens, or peptides derived therefrom. In contrast, when used individually, 16/50 (32%) contained antibodies recognizing lung TA-antigen L978P, and 12/50 (24%) contained antibodies recognizing lung TA-antigen L984P. Serum samples obtained from normal donors were also evaluated: 1/23 (4%) detected L978P, and 0/48 (0%) detected L984P.

In conclusion, peptide-array and/or full-length protein screening using multiple TA-antigens may be used to evaluate a biological sample obtained from a patient having or suspected of having lung cancer for the presence of antibodies recognizing one or more TA-antigens. The efficiency of detecting cancer using a multiple TA-antigen screening methods may be enhanced, in statistically significant manner, compared to screening methods using one TA-antigen. Such multiple TA-antigen screening may be of value in a variety of diagnostic, prognostic and/or therapeutic methods in lung cancer.

EXAMPLE 41

Analysis of TA-Antigen L984P Expression by Immunohistochemistry

In this Example, tissues samples obtained from patients having a lung cancer, for example a small cell lung cancer, were examined by immunohistochemistry (IHC) for expression of a tumor-associated antigen (TA-antigen), for example the lung TA-antigen referred to as L984P. As disclosed herein, IHC may be used, for example, to characterize the intracellular localization of L984P and to compare the cell-to-cell pattern of expression in individual cells making up a small cell lung tumor, or in cells contained in another tissue.

Rabbit polyclonal anti-L984P affinity purified antibodies were used in the analysis of a variety of tissue samples, including primary small cell lung cancer (SCLC) tumors and normal tissues. Affinity purified rabbit antibodies were tested using a standard 45 min primary incubation protocol, at a concentration of 5.0 mg/ml. Briefly, four-micron sections of formalin fixed, paraffin-embedded normal tissues and an SCLC sample designated Q2594 were utilized, as provided from QualTek's human tissue bank. Tissue sections were de-waxed through 4,5-minute changes of xylenes followed by a graded alcohol series to distilled water. In these experiments, SHIER heat pretreatment was performed in the capillary gap in the upper chamber of a Black and Decker Steamer (for description see Ladner et al., Cancer Res. 60:3493-3503, 2000).

For experiments described here, tissues samples were first incubated with blocking reagent for 15 minutes and then primary antibody (e.g., rabbit anti-L984P antibodies) for 45 minutes. Secondary Antibody (Goat biotinylated anti-rabbit) was added and incubated for an additional 25 minutes. To prevent detection of non-specific background signal, samples were then incubated with an Endogenous Peroxidase Blocking solution for 3×1.5 minutes, and then with Avidin-Biotin Complex—ABC/HRP for 25 minutes, followed by DAB Chromogen for 3×5 minutes, and Hematoxylin Counter Stain for 1 minute. The primary rabbit anti-L984P antibody was evaluated at concentrations, for example, 5.0 mg/ml (45 min.), 3.75 µg/ml (45 min.) and 2.5 µg/ml (45 min.); a primary antibody concentration of 2.5 µg/ml (45 min.) was considered optimal under the conditions of these experiments.

A number pre-treatment conditions were evaluated in preparing tissues for IHC. Including, no pretreatment and no enzyme; no pretreatment with enzyme diluted 1:15; 20 minute SHIER1 and no enzyme; 20 minute SHIER#1 with enzyme diluted 1:40; 20 minute SHIER#2 with no enzyme; and, 20 minute SHIER#2 with enzyme diluted 1:40. In the experiments described here, 20 minute SHIER and no enzyme treatment gave the best results. After staining, slides were dehydrated through an alcohol series to absolute ethanol, followed by xylene rinses. Slides were then permanently protected with glass coverslips and permount.

Slides were examined under a microscope in order to assess staining. Positive staining is indicated by a dark brown chromogen (DAB-HRP reaction product). Hematoxylin counter stain provides a blue nuclear stain to assess cell and tissue morphology. Digital images of representative staining were captured using a video camera from Olympus, images were saved as compressed jpegs.

The data indicate that L984P antibody reactivity was observed in SCLC tumor cells under all six pretreatment conditions tested. The L984P specific signal detected in SCLC cells was cytoplasmic and granular; a perinuclear and nuclear localized signal was also observed. In these experiments, the pre-treatment condition SHIER1 with no enzyme appeared best, although no pretreatment with no enzyme gave similar results. Of the ten primary small cell lung carcinoma samples tested, 9 (i.e., 90%) were positive for L984P. In the SCLC primary tumors examined, rabbit polyclonal L984P antibodies stained about 50% of cells in the tumor sample, visualized as a cytoplasmic granular signal; perinuclear or nuclear localization was also seen in some cells. The cytoplasmic and perinuclear staining patterns appeared to be more evident in actively infiltrating tumor cells with adjacent established tumor cells exhibiting a L984P signal that appears more diffuse and cytoplasmic, which may be seen in patients with of high grade SCLC. Negative and positive tumor cells were often observed in the same focus.

In four of the primary SCLC tumor samples and one metastatic SCLC sample examined, a nuclear and cytoplasmic L984P specific staining pattern was observed. Such a pattern of L984P signal may be associated with proliferation and/or metastasis.

Small cell lung cancer is a bronchiogenic carcinoma that arises from bronchial epithelium. In this context, two tissue samples exhibiting abnormal bronchial epithelium were observed, which may represent the early stages of a developing tumor. Within the same tissue, a more normal appearing bronchiole exhibited no reactivity.

Normal lung alveolar epithelium exhibited no L984P specific signal.

In conclusion, TA-antigen specific antibodies may be used to examine lung tumor and non-tumor tissues by immunohistochemistry. Such an analysis may be used to characterize the intracellular localization of, for example, the lung TA-antigen L984P. Such IHC data may be of value in a variety of diagnostic, prognostic and/or therapeutic methods in, for example, lung cancer.

EXAMPLE 42

Identification of Antibodies Recognizing Tumor Associated Antigen L552S Peptide Specific Antigenic Epitopes in Biological Samples from Patients with Lung Cancer This example describes the detection of antibodies specific for the lung tumor antigen, L552S, in lung cancer patient serum and lung pleural effusion fluid and the identification of specific epitopes recognized by patient antibodies. Furthermore, the applicability of using peptide-array screening to specifically detect the presence of antibodies recognizing the tumor-associated antigen (TA-antigen) referred to as L552S was examined, and the peptide-array screening method disclosed herein was used to characterize a patient's antibodies recognizing L552S based on antibody specificity, sensitivity (intensity) and the pattern of peptide epitopes recognized (clonality).

Peptide-array screening eliminates the possibility of detecting non-specific background signal that may result from, for example *E. coli* host cell proteins, which may be present in a preparation of recombinant L552S. The detection of such non-specific *E. coli* background is due to antibodies that are naturally present in a biological sample (e.g., sera or effusion fluid) obtained from either a cancer patient or a normal donor (i.e., negative control). However, the presence of such non-specific antibodies may impact the sensitivity of a diagnostic method intended to detect a patient's antibodies recognizing one or more TA-antigens (e.g., L552S).

A peptide-array screening method was used to detect a patient's antibodies that specifically recognize one or more antigenic epitopes of TA-antigen L552S, thereby eliminating detection of non-specific background signal from antibodies that are not TA-antigen specific. A consecutive series of 15 overlapping peptides (20 amino acids in length and overlapping each preceding peptide by 10 amino acids), covering the entire length of L552S, was synthesized. The amino acid sequence of these peptides is provided in SEQ ID NOs: 2143-2157. Each peptide was dispersed into individual wells of a multiwell plate and incubated with a serum sample por lung pleural effusion sample obtained from a lung cancer patient or normal donors. An ELISA was used to measure the signal detected in the presence of an antibody recognizing a specific L552S peptide. The results from this analysis clearly indicate that antibodies contained in patient samples recognize L552S peptides. The data are summarized in Table 33.

TABLE 33

| Patient | Biological Sample | L552S peptides detected (SEQ ID NO) |
|---|---|---|
| 13 (lung cancer) | serum | 10, 11 and 14 (2152, 2153, 2156) |
| GB-25 (lung cancer) | serum | 11 (2153) |
| GB-11 (lung cancer) | serum | 9, 10, 11 (2151, 2152, 2153) |
| normal donor 17 | serum | 11 (very low signal intensity) (2153) |
| normal donor 438 | serum | 11 (very low signal intensity) (2153) |
| normal donor 445 | serum | 10, 11, 14 (very low signal intensity) (2152, 2153, 2156) |
| normal donor 11 | serum | 11 (very low signal intensity) (2153) |
| normal donor 480 | serum | no peptide detected |
| 10 (lung cancer) | lung effusion fluid | 10, 11 (2152, 2153) |
| 14 (lung cancer) | lung effusion fluid | 11 (2153) |
| 15 (lung cancer) | lung effusion fluid | 10, 11, 12, 14 (2152, 2153, 2154, 2156) |
| 18 (lung cancer) | lung effusion fluid | no peptide detected |
| 12 (long cancer) | lung effusion fluid | 9, 11 (2151, 2153) |
| 208 (lung cancer) | lung effusion fluid | no peptide detected |
| 3 (lung cancer) | lung effusion fluid | 10, 11, 12, 15 (2152, 2153, 2154, 2157) |

These data further indicate that the TA-antigen L552S is immunogenic and that peptides derived therefrom, which contain TA-specific antigenic epitopes, may be used in a variety of diagnostic, prognostic, and/or therapeutic methods for cancer, including the development of a cancer vaccine.

From the foregoing it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (2157 sequences)

SEQ ID NO: 1 - DNA, 527 bp, Homo sapiens
ccaccagtccacaaatgtgactggtaagggatctagtaacagaggatggagttgggcagaatattatcctggatgatatgcacccagcactagaatacacctttcattagaatgaagagaacagacaaagccctcagaaaagatacaaaggcagagacattgattagaacattatctcataacagaggtggggccattacccaccattattgtaaaataactgtaactaaccaaaacacatacaggcttctttaatggagttaataaaactatggcacattgggaatcaggggcagaggtactgttcccagacggaaaactgggataaagggagccatgctgacagggccttattccagtctaggttgttagaaaggagccctagcccagaaatgacagcaaatagccataatcattatgtggggctgaaccagaggaagccaggctgagccaagaagctggaagtatcttgaacggctctccaaatccaaagattatccatactctttatccctccagcgatgtgt

SEQ ID NO: 2 - DNA, 490 bp, Homo sapiens
ccaagagttctccactgtgaagactgaaaggacctggtgacatttcggcatcagtcctgttaccacttggaggtaacagaagcaggctcgtgtcctcctttaattctaccacactacatgactcgcaattggttctgaaattagaacgttcaccatcgtacttaaaatcttaggggcatgaagagtcagctagaacaaggaaaaagaaagtcgcaggtagtaggtaagtaggtgggcacatgaaaagccaagctgctctgtccaacaccagtgtacatgtgctttaactaaatgaactccagaggccaacagcagcagacctgctcaattcaccttccaaatcagaacaagaccaaaaagctcaggcttgagttgtcaactatgcataggttccgccagtgctgaggggtgtgaggctctagttgtgaagaagctacaagaaatcatgatgcatgtgatctgggccgcactggcatttgcagctattcag

SEQ ID NO: 3 - DNA, 464 bp, Homo sapiens
ggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagtttaaatttcagcttccctactttgtaattgactgact

SEQ ID NO: 4 - DNA, 510 bp, Homo sapiens
ccttatcacactgtaagtggtccaagcccatagggatgctctttttggttcctggaatttccagttggatgtgacagagatctttcagtataggtctaagtcaagagtagcctctgggttgaggtgggctgggagattaacatcttacctggggtccttcagataaacctgttggtttttcctgtctcatacaggcccatcttaagttttgatgttgaattaaaactacttctacccccttagttataaaaaaggccacaaggagcatttatgtggatatctggaagtgagatagttattccattcccaggaaaagaaaaataaagctaagttacaaaactaaatctatatgcaataaagttattatatactgctttgtttaagcagagtcctctggaatttatgtacagtacattagttttcagctatttatattccacaagttagaccttaagattctctggttttaagacaattgttaaagatacttctaaagctctgagcagttca

SEQ ID NO: 5 - DNA, 452 bp, Homo sapiens
acagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggtaaatcatctcctttatttggtgcctcatgtgagtactggttccaagtgacatgacccagcgattatgtttacagtctggacttctgatcaagagcgttcttgaaattttccttcagttttaagacattttcatgcaggcagagtgttcttcccctaaaggcacttgacactcatttttt

SEQ ID NO: 6 - DNA, 336 bp, Homo sapiens
tatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaa

SEQ ID NO: 7 - DNA, 376 bp, Homo sapiens
ctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttattttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctg

SEQ ID NO: 8 - DNA, 406 bp, Homo sapiens
ggtagggagcaattctattatttggcattgcatggctgggttgaattaaaacagggagtgagaacaggtgagtctagaagtccaactctgaaaaggaccactgtacatttgaacacacggctgtgttaaagatgctgctaatgtcagtcactgggtgcactaaaggatctcttattttatgtaaaacgttgggattgacaagatagatctgatactctgttaagttaccctctgaagctacttcttgtgaaatactaatgacagcatcatcctgccaagcgaaagaggcaggcataagcaaggacaaattaaaagggggtaagagccttatcatgatgaggagtcttgttttgacatcttgggaaaagctgtccatagtgtgaagtcgtcaatttctcaccatggt

SEQ ID NO: 9 - DNA, 330 bp, Homo sapiens
actactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctgg

SEQ ID NO: 10 - DNA, 449 bp, Homo sapiens
ctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgcgggtaagttgaggttatcttgggataaagggtcttctagggcacaaaactcactctaggtttatattgtatgtagcttatattttttactaaggtgtcaccttataagcatctataaattgagttctttttcttagttgtatgg

SEQ ID NO: 11 - DNA, 472 bp, Homo sapiens
cctcgatgcatgctgctctacctctcatcagcccacagtctgacacgaggtcatctttggtctgtggtgaggtatggatgtctgcagtctacacaacagccctgcagaacgggcctggacaacccttgggggataagacagccacacatggctcaggctgttaggtgtccactgtcacagtccaaagagaaaggtacggcctccaagggggcagcttaagccaacatgtaagacttgggcacgatgaaaggacgggggtccagctacgaatgtttttgttcttgatgtcaagttgccagctactggaaggcaggagcagtttcttctttttcccactctgtgctgggtacttgggagaggcgaaataaataccagactgtccactcctcagcctaaggtccttctcaagtcctgcacactcagcacttgctctttaacgtggcatatgttcccccatcttcccctggtaatg

SEQ ID NO: 12 - DNA, 371 bp, Homo sapiens
ttttttttttttttttttttttttggaratttgkcacattttattcagwatttctgctgcactgccagcctagggatgcacttgattcccaagaaatgcaactgtcctattcgcaragccgtccacaggtacctaccccctggactgcagcaactttattaccttaactagcacaraacagaggttgatttaaactccttacactcacttctcaratcaatgaatgggcaaaraaacmcctcatggctctgggaaggcatgctgaracccgtttttgcaagtcctgaggaatggaaraatatagctgccaggtatcccaagtctagggcagggagggkagtatcggcatcactttcactgcattctgttgg

SEQ ID NO: 13 - DNA, 493 bp, Homo sapiens
  misc_feature 198, 199, 200, 201, 202, 203, 204, 205, 206, 207, 208, 209,210, 211, 212, 213, 214, 215, 216, 217, 218, 219, 220, 221,222, 223, 224, 225, 226, 227, 228, 229, 230, 231, 232, 233,234, 235, 236, 237, 238, 239: n = A,T,C or G
ccagtccaacctgctcctcattattgtataaatgagcagaatcaatatggcggaagccagctycaattgccaatttggtggcctctaaagctttacttttaggaacctctgcaggcgcataggtgccaaatcccaggacaggcatgaagtgaccatcattcagcttcacacactgatatttcgaatccatttctgtcnnnnnnnnnnnnnnnnnnnnnnnnnnnnnnnnnnnnnnnnnnccaacctgctcctcattattgtaaacatgtgcagaatcaatatggcggaacccagcttctattgctaattttgtgacctccaaagctttacttctcggaaccttggttcttccgagcgctcagcaatcccgccgagcttctttgagacgtcctcaggtgtcctttgacgatgcgtcctccactttcacacactctagcattccttcactggggtcttcattgccccacattgggcagccaggaatgttggggtg

SEQ ID NO: 14 - DNA, 540 bp, Homo sapiens
ccagatggtccataatatgtcaccgagcaggtgaatggcatttgtatgtcagccttggttgtcttgtactccagggtggaagtcatggtatagagctgagtcactgggtccatttcctttttaaaattatgaccaccgctccttcaaggggatgtagcacttttccattcctgtaccatgtgatattgccatctggataactgtcttctgaaatgcagtcacccaacttttttagctgctctgtttcgagaaacagtgctttgcttacaatttcaggtttagatggttgcttgaacaccttgactattgtaggtgcctcaaacacgttgtcctcagttactagcatgcacacaaatctcttttcatcactgatccttgcattactgatagacaaagtgtagttttctgagaggttcaatctgtctttgtattctggtacatcgtcgtactgcacacttttctttgtagaggatctgaaggcaataaatactggggagccatcgggcttttcatatttccatttgcccaaacatgagattc

SEQ ID NO: 15 - DNA, 421 bp, Homo sapiens
tacccacctccagcctcccatgtgagcctgtccttatgtatagtgtccaacctctgattctagcagtcaagtgtcttccccaatcctaatgtcccctgatatgtctctagcgacttgaccatctcttgttccttgggactggggccagcctcttgtctgcccacttccctctcattagtcagatagccccaaaggctctatctttagctcccagagaactttttggtcctcagtatttcccttcccctttccttcctattccccacaactgggggagggaagggagaacaggggcacctgatcatcaatctcccctgcccctctcttgaagccccctagatttggatgaagagcaggccagtgagcagggcaaagcctgctaggagcagaatgaccttgaggatcctttgctcagaactgg

SEQ ID NO: 16 - DNA, 236 bp, Homo sapiens
gccgtgtgtgcttttcccagtgccgaggtacctatcgctcacggccaggagcttgtcgtggctgacagcaaagagctgctctctgtgggcctgcttcatctcatccgagaggccgtacaagaagtggtccattcctttgtctgaaggagcgacaggagcatctacggttgagaagacagaaagtttggcttcgtcgatgtcttgctgtgtgaattttccagacttagcccagtcga

SEQ ID NO: 17 - DNA, 424 bp, Homo sapiens
ccagaaaggtgacagtggttttccagggcctcctgggcctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacatcgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatgg

SEQ ID NO: 18 - DNA, 154 bp, Homo sapiens
gtcaccaactccttcagcgcctccacagggstttcggacatgacagcaaccttttctcccaggacaattgaaatttgctaaagggaaaggggaaagaaagggaaaagggagaaaaagaaacacaagagacttaaaggacaggaggaggagatgg

SEQ ID NO: 19 - DNA, 445 bp, Homo sapiens
caacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaaagtgtgactatgaaaatgttccaaccactgtatttactcctttggaatatgg

SEQ ID NO: 20 - DNA, 211 bp, Homo sapiens
gggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttgg

SEQ ID NO: 21 - DNA, 396 bp, Homo sapiens
tgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattgg

SEQ ID NO: 22 - DNA, 277 bp, Homo sapiens
ggaaccatgtggccggcgcccttgatcgtgagaaaggcgatgtgggagaactccttcacgaagccggcaatctgctccccgctgtccccgtacttcactaaccagggccggcgctgcacctccatcttctggttgagggaatccacaaaccactcatcccccatgaaattgcaggccatgtctacatctccattatataataggatctgggatttctgtgagctaagcagcttcagatactgggagttcatgcttcggtagagacggcggtactgta

SEQ ID NO: 23 - DNA, 634 bp, Homo sapiens
tctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaattttgtttcctaggttgaaggtctaattgatacgtttgacttatgatgaccatttatgcactttcaaatgaatttgctttcaaaataaatgaagagcag

SEQ ID NO: 24 - DNA, 512 bp, Homo sapiens
gcaaaacaagcctaagcaagcacaacgaagagcagaagtcagtgaaattaaaaagaggaaaaagaaaaatcataaaaatcataaaaagttatttctttgaaaagatcaatgaaatttagcaagactgacacagataaaaaggaattagacccaaatcagtgaacaggaatgaaatagaggatatcactacagaggctgcagccattgaaaggataattaggaaatcccacagataactttgtgctcataaatttgacaatgtagaggaaatatctttagttttaattagctttttattttagtttttctcaaaaactaaaacttaataaaactcaaccaagacaaaatagacaatcagaatgtaggcatacctcagagatgtggcggatttggtttcagactactgcaataaaccaaatatggcaataaaaggagtcacagaaagtggtttcccagtgtatatatataaaagttacatttactctatgaagtgcaataacattttgtctaaa

SEQ ID NO: 25 - DNA, 461 bp, Homo sapiens
ctctgtttcagcacctcattgggattattgaactcattaaattctttacatgaacttgaattgttcattgaaatctctagccatttccctggttaaacaggataatctttttttttcactaaagaacattcgtggtggtttagtgatgaggttaatattcccctcttgtccacctccacattggaaaaaccacgttggactgagttttgaggagcaaagaactaatcacttgaccaaaggggccctgtatccccacaagccctgggtatttttctctcatagagagaagagggtctgtatggatacctgaaaatgtgattttatatattcttggcatccaggggagaaaaatcaaaaagcaaggaagttacagttatctccccagaaattaatgggtcatgtcaagactataggttttcatttccttctgttgcttgttagaatgatgttcttgtgggaaa

SEQ ID NO: 26 - DNA, 317 bp, Homo sapiens
tgctggagtcggaactgctgcctttgtttggcggccttgtttcttaaatcagttccctcttaggatttattacactaaaaaaaaattagtttttgaaaagaaataggagaatacagaaacatgaatttcacgaggctatcatctaacagtgggggctttctacacacgtggtgccaaaatgtgtcattctgagtcaattgcaattcctctctaggagtgaaaagagataaaagataagccaagaaccctggacagattcttggtgttggtgacaaagaggaaaggacctgagaatggggctggtggggagagggggg

SEQ ID NO: 27 - DNA, 250 bp, Homo sapiens
taattgctgtgattattagaattctatcatgactgtattgtagtttttgctctattycagataagcmagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaa

SEQ ID NO: 28 - DNA, 532 bp, Homo sapiens
cctatatcattcatttatacagaagctgcttgctgcttagcaagttggtgggtttgattttccttggttgctttgcagacctcccttgagaggattccttctggatggagatttctttgttgctgtctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcag

SEQ ID NO: 29 - DNA, 486 bp, Homo sapiens
ctgtttttggacttaattaacywttgcaagtggaaaccaagaaataattgtagcataactctctctattgtcatgttgcttctttctgcaaatatatcttacaagttagactttaaacctttgatctcccacaccaaaagagaaaataatatttatatggaagtaattttattttagtgtttgtgatttattgtggagagcaggbgtttaaaaattttagaatttctttttaacaaaatcaaatacattgttaaggtaacaaagaataattcactatttcagcatttcaaagcaacatattctacaacttcaaagatatttgcaaaaataatacaactgttgaagttcaaatgttatggaaagaaacattagaagtatgaaaagtggtacaaaaacatgtttctttttattctcttggatatatatctatatatttaggaaaatacatatatgtatgtgtatgtatatatatgtatgaaaatatac

SEQ ID NO: 30 - DNA, 240 bp, Homo sapiens
aagacctgaggaaggaaaacaaattggcttcctgctgaagaakcaaaatagacattttttaatgtctcttgaccccagttccaagttcaccctgttgcctgttcttcctcccaccttttggggttctataactgcatcccccacacatctttcaccaccaccccatacataccagctctcctgttgtgggattcaggacataggaagagttgctgaaggcacgggtgcttttgggattcg

SEQ ID NO: 31 - DNA, 233 bp, Homo sapiens
ccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactgg

SEQ ID NO: 32 - DNA, 233 bp, Homo sapiens
gaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctagg

SEQ ID NO: 33 - DNA, 319 bp, Homo sapiens
ctgggcctggatggtctaggatagccttactcacttgcctggcaggtgacaggctgttggctggaattgcttggttctcctccatgtggcctctccagtaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtgg

SEQ ID NO: 34 - DNA, 340 bp, Homo sapiens
tacagatttaattcatgttattaactccctgccttttacctcctccctcctcccttggcacaactgccagatggatgtggctggaagtcagaggacattctcgtgggttcgtgggcctagggtacaaatgacctcagcgtgacagcaaacaggacagagaagaccaggctcttactcaggaatccaccagccaggagaatgacaatgttgaacaccggaaccctgatgatatctgtcacatttgtaaggttgatttcagagtcaggagtggagacatcggcagttgacttgggtggagcttgggtcacagttctggggctggtatagagtgggcacaagg

SEQ ID NO: 35 - DNA, 170 bp, Homo sapiens
acatgggtccttcactcctcgctgagatgttgcggcagccttttcttccaatgcggttgtggcaggagaatccacggatgtaatgttttcacctttttccctgagggtgctttctgaggaaccagyccttaagaggtggggtcttggattcctgacccaggcgtccggca

SEQ ID NO: 36 - DNA, 475 bp, Homo sapiens
ctgtttttggacttaattaaccattgcaagtggaaaccaagaaataattgtagcataactctctctattgkcatgttgcttctttctgcaaatatatcttagaagttagactttaaacctttgatctcccacaccaaaagagaaaataatatttatatggaagtaattttattttagtgtttgtgatttattgtggagagcaggtgtttaaaaattttagaatttctttaacaaaattctaaagagaaaataaaaaagaaatcacagtatttacagagataacagaatggcttagccatgcaaaacaaataactttggtttttccccttttactttggtttaaatgttgaccaagattcaattttttttcctgccaaataaaacttcaataaaagtttagaggcaaaataacgtattttctttttttcccataatattttatacagcatcgagtctaagaatattttatgcattt

SEQ ID NO: 37 - DNA, 246 bp, Homo sapiens
ccttgagcttgggccgggcactgaggcgccccacatatgctgagagcagggggaacgcatccaggcagccaggggctaggacctcatggatcagcagcaagtccagcaggttgtagtcagcgaaggagatctggtctcccacaatgaaggtcttgcctccctggttctgggacagcagggtctcaaaaggcttcagttgcccgggcagtgccttcacatagtcatccttgcccacctcatagttgg

SEQ ID NO: 38 - DNA, 512 bp, Homo sapiens
gctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaat

SEQ ID NO: 39 - DNA, 370 bp, Homo sapiens
ttttatgaacaagatataaggatcaaaaaaaagggtgttgatatgtttttccaagcagagatgtactcgactctgtcctatttagccttcccatacctgacttctaatcacttttcctggtgccctyccatctccctaaccccccctcacagggatgcctcctcccaaggctccagaaactctgaccctcgcactgctggagggagcccatgaattgctggtcaatatcgctcatcctctakactccatcctgcgtgtgcttcttcctacaagagctagagaggcactgactgataaatacctgtcacctgcccctttcccagagggtgaaactccacccactcccactgcagaaatgaatcttaaatgg

SEQ ID NO: 40 - DNA, 204 bp, Homo sapiens
cctgagggttttccctttaaattttcattgagttgtccatctccagcatatagggcttcaggagcagagcagaccttgtttttagtggttccatgggataaaatgggattggaggagctagaagaattcagggtctggtccaatctgccagtcttcctgaaatatcgaaaatacaccagggctgctatatcagagccaccctgg

SEQ ID NO: 41 - DNA, 447 bp, Homo sapiens
caggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtagtggaggacgggcaacgtgcatgtgcaggctcaccactcccagg

SEQ ID NO: 42 - DNA, 498 bp, Homo sapiens
ctggttttgtaaaaacagtctctttattctactgtgctgaaaccctcaccaatatagaaaattagattctcattgcactgaactatatttatatgcctaagtatgtagaagtaaaattatataccccaaaaggattttatcttgttgtatatattaaatgttatttctgcatatagggtcttttatggagaaactgatgatgataagcttaatactcacttgtttagcagcatctgaatgcacaaatgctttatatatctcttctgctttacagggcaaaagatcagactctgttttcttatagtcttcacaagccagccagaactcaatattctcctcactgaattcagactttaggaaacttccaaagacattttgaccagtttggttggcaagaagtttttccagagattgagaccattgcattacttcagcagcagaaagtacatccttggacttggaagatttcattccagattccagatgtgggatcataga

SEQ ID NO: 43 - DNA, 312 bp, Homo sapiens
caggaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctc

SEQ ID NO: 44 - DNA, 417 bp, Homo sapiens
ctaacacatttactctccactattcgtactctggtagccatgttaaccccatcagagattccttctcaagccatgtctcagagctgagaggcatcccagcaagttttgcagctcacagttttttccgtaaattacttattctataaaattggagtaggccataaactttggagggccctagaccaattttttggattatttttcgtcttctatcattccgctgatcttagatattctctgcattaaatattaaatatcacttctaggctgaaaaatccccctaaaaatatttctagctcagatttttcctccaaattctgcaatagaagatcacaatgtgaactctgcatctccatgttaaagtctaatggacattcacacttagcatgtctcaaagaaatctcatgtaaaccatgg

SEQ ID NO: 45 - DNA, 494 bp, Homo sapiens
cgcgtgtctgtggtatgtgtacacgtgcatgttctgcatgtctgtaggtcacacatgctttggtgcatgtacacgtgtgtgtgtgtatgcgtgtaggagctcacacttgtgtacacgtttgtgtgcatgcatgtgtgcaggagcttgcacgtttgtggtgggtacatgtacatatgtgagtgatcctgtgtgcaagcccccatgtggacatggctatgagtgagcgtggagccaaaagccaggtaacacgcatgcagcaggcccactgtgcgtgtctgagacggtctgtggcagggactgggtgtgaatcatgcagcaggcccactgtgcgtgtctgagacggtctgtggcagggactgggtgtgaatcagtgaccgtgtctctgaccaacatgctgaattacaaattgataatttattaacctgtgcagcaacaaataagatttttcaaaactcaacaaagtgctcaaagttgacattacttgcttcaaagtt

SEQ ID NO: 46 - DNA, 516 bp, Homo sapiens
ccagtccaacctgctcctcattattgtataaatgagcagaatctatatggcggaacccagcttctattgctaattttgtgacctccaaagctttacttctcggaacctcctcctttggccgtcatttgatcattcaactctttgtcagtggcaactcccgctattttggtgtgttggtttgttactacacagtgagcacaaacatggtggtccaatacagaggctcttcctgtcaggtgtcaaccagaaagttcatctaacactgtgatatttgcatccttcttgaacagttgttggctgaagattcatttgatgaatcgatttttcaaaagagatgattcttggttcttccgagcgctcagctctcccgccgagcttctttgagacgtcctcaggtgtcctttgacgatgcgtcctccactttcacacactctagcattccttcactggggtcttcattgccccacattgggcagccaggaatgttggggtgatcagacacaacaccaggtcatg

SEQ ID NO: 47 - DNA, 459 bp, Homo sapiens
ccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgaksaaaaaaaaaaaa

SEQ ID NO: 48 - DNA, 430 bp, Homo sapiens
cctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtgg

SEQ ID NO: 49 - DNA, 288 bp, Homo sapiens
ccatccgaagcaagattkcagatggcagtgtgaagagagaagacatattctacacttcaaagctttggwgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccrtggagaagtgtaaagatgcaggattgg

SEQ ID NO: 50 - DNA, 411 bp, Homo sapiens
ccagagaatgacattcatgtccccgtggatcccttgcagagagtacatggagccactgccaccagtggtgatggaaagcactgtcttcttactccggaagggtcctttgtcatacatggcagcgtaagtgtaagcaaactctcctatgaacactcgctcaaaccagcctttcagaatggcagggactccaaaccactgcagggggaactggaatatcacaaggtctgcggcttccagcttcttttgttcagccacaatatctgggctcagatggccttctttataagccagaacagactcggcaggatactgaaagttcgcagggtccttcagtttacctgtgatgtcctttctggaaatgatgggattgaagttcatggcatagaggtccgactccaccacctcccatcc

SEQ ID NO: 51 - DNA, 503 bp, Homo sapiens
gatatcttatgattaaaaacaaattaaattttaaaacacctgaagatatattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattaaga

SEQ ID NO: 52 - DNA, 503 bp, Homo sapiens; identical to SEQ ID NO: 51

SEQ ID NO: 53 - DNA, 531 bp, Homo sapiens
tttttttttttttttaaaatgaggatattttattatttcaggtaattttcccagaggkgagaatagtacatgggaaattctctttaggccaggtctagtattacagkgtggkgctcaaggccgcccatcagaacagtgatactctcccaacagatttcatccaccccgtctccactaacttttgccataaaaattcctctgaattgtatcttcttggaagaagtaaatatctgttcgactatacaaagaaacagagaaaccactcccattgcaatcaatcttcaagagagggagcaggcaagccgtgttctttctgctgagttttatagactctgacaagctgtgaaataaacataaacagaagacaaaacagtgccacaaataagcagtagatgaccctgtgacaagacggcattgcagaacaaagactgacgtttaaaggggagtcatgcagagtaacatgggaacacaagcctgacaacctggtcagcttccacttactctagctcctttgaactctcaacactaaaa

SEQ ID NO: 54 - DNA, 450 bp, Homo sapiens
ccatgggtgtctggagcwccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcag

SEQ ID NO: 55 - DNA, 648 bp, Homo sapiens
caacttcaaccacaggctgctggasatgatcctcarcaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctrcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggygayttcagcaagctacagcaaagcccattggccggaaaaaatatcaagggtcaaat

SEQ ID NO: 56 - DNA, 536 bp, Homo sapiens
ctggcatgagaatatttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggacctgcccgggcggccgctcgaagccgaattccagcacactggcggccgttactagtggatccgagctcggtaccaagcttggccgtaatcatggtcatagctgtttcctgtgtgaaattgttatccgctcacaattccacacaacatacgagccggaagcataaagtgtaaagcctggggtgcctaatgagt

SEQ ID NO: 57 - DNA, 391 bp, Homo sapiens
aggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttatttgtctagttggatttcatttcttctggaaaatttattgtttattggcatgtgacccttgactgatggcttcattagcattytgtttttctttttggatccttaatagaaaactcaat

SEQ ID NO: 58 - DNA, 455 bp, Homo sapiens
gaagacatgcttacttccccttcaccttccttcatgatgtgggaagagtgctgcaacccagccctagccaacgccgcatgagagggagtgtgccgagggcttctgagaaggtttctctcacatctagaaagaagcgcttaagatgtggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgttcctaaaagtaaagctctagaggccgtcaaattggcaatagaagccgggttccaccatattgattctgcacatgtttacaataatgaggagcaggttggactgg

SEQ ID NO: 59 - DNA, 398 bp, Homo sapiens
  misc_feature 264, 266: n = A,T,C or G
ctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactngntcggatcatgctaaaaggagataatattactctgctacaaagtgtctccaactagaaatgatcaatgaagtgagaaattgttgagaaggatacagtttgtttttagatgtcctttgtccaatgtgaacattt

SEQ ID NO: 60 - DNA, 532 bp, Homo sapiens
gacttctgagacctggggcacccgggcctttgcggcagctactggcagggcctggccacctcataggactcagttcccttctgaacactcgggggacatgggcctctaactgcccactctgatatgcctgggtgagcctaggagggaaggctctgatttggatttctccagtcaaagctcacagaaaaaaacctggcactttgattttcatgggatggtcctaacagggtcagtcacctccgagcagtttgggaacccagtttcttgtcctgggccctcaggtcagcctggctgaattaggacccttccttggcacaggggtgagaaagagcttggggaacgcttggcattatggagggctggaaggggctcaaccccgatttggagagaagtttgggatggagtgggcgagagattgagagagcgagcaggaaaagaggtcttggagcctgggactgatggtggataaggcctggaaagaasatgacsaggaggaggagagagggaagtgggtggatgaggagcaggctga

SEQ ID NO: 61 - DNA, 466 bp, Homo sapiens
gcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcgga

SEQ ID NO: 62 - DNA, 548 bp, Homo sapiens
ttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttc

SEQ ID NO: 63 - DNA, 547 bp, Homo sapiens
tttccaaagcggagacttccgacttccttacaggatgaggctgggcattgcctgggacagcctatgtaaggccatgtgccccttgccctaacaactcactgcagtgctcttcatagacacatcttgcagcatttttcttaaggctatgcttcagtttttctttgtaagccatcacaagccatagtggtaggtttgccctttggtacagaaggtgagttaaagctggtggaaaaggcttattgcattgcattcagagtaacctgtgtgcatactctagaagagtagggaaaataatgcttgttacaattcgacctaatatgtgcattgtaaaataaatgccatatttcaaacaaaacacgtaatttttttacagtatgttttattaccttttgatatctgttgttgcaatgttagtgatgttttaaaatgtgatcgaaaatataatgcttctaagaaggaacagtagtggaatgaatgtctaaaagatctttatgtgtttatggtctgcagaaggatttttgtgatgaaaggggattttttgaaaaat

SEQ ID NO: 64 - DNA, 528 bp, Homo sapiens
  misc_feature 374, 443, 444, 452, 476, 489, 515, 523: n = A,T,C or G
cacctmctcccsccwggcgcttwctcsgacgccttgcccascgggccgcccgaccccctgsrccatggaccccgctcgcccsctggggmtgtygatkctgctgcttttcctgrckgaggctgcactgggcgatgctgatcargagccaacaggaaataacrcggagatctgkctcctgcccctagactackgaccctgcckggccctacttytccgytactactacgacaggyacacgcagagctgccgccwgttcctgkrckggggctgcrasggcaacrccaacwattyctacacckgkgaggmttrcgackatgctwgstggargatagaaaaagttcccaaastttgccggctgmaagtgaatgaggacnaccagggtgaggggtacacagataagtatttctttaatctaakkwccatgacatgwgaaaaattctttnncggtgggngtcaccggaccggattgagaacangtttgcagatgangctactgggatgggctcctgcrcacnaaagaaantatca

SEQ ID NO: 65 - DNA, 547 bp, Homo sapiens
  misc_feature 408: n = A,T,C or G
kgaatgaasaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacagtctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaangtatcaaacagctactgaaacaagggtcagtgcagaaggtatacaatggactgcaaggatattgagagtgaataaaattggactttgtttaaaataaagtgaataagcgatatttattatctgcaaggttttttttgtg

SEQ ID NO: 66 - DNA, 535 bp, Homo sapiens
ggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaaga

SEQ ID NO: 67 - DNA, 527 bp, Homo sapiens
atttctgccacttaattcaaacagtcatatgcaggtcgcttaatttatttgtgcttttgtttcatcttctacaaggccctcttagctctaaaacttgacagtggaataaggaaatgtttttccaaatctgcattgccggtgagatcctcaacatcagcatgttgagatggacctcaaccccacctctaaccctgaaacacactactcgatattatcttaggtatgttttagggtttagtttgtaaaataataatttatttttgaaggaaatataaaatattaaagagtaataatagctatcattttttaagattcaatctaaaacaatggactctttttttttccatttgtgatgtagataagcaagacaattttgatcatgagtggtgaaaagaggatcaaacttgactattcttgcaatggcagtccagcaacaagcctttcatttacattaaattataacttttcattcattcctaaaccaaacttaaaattctgctttcctttgagtagaaggtatttaactt

SEQ ID NO: 68 - DNA, 431 bp, Homo sapiens
gggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgwtcctttagtgcaatacaataaaactctgaaattaaaact

SEQ ID NO: 69 - DNA, 399 bp, Homo sapiens
gacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaraaaaaaaaa

SEQ ID NO: 70 - DNA, 479 bp, Homo sapiens
cgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaatgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattaggatatttgacttaaactatctcaataaagttttgcagctttcaccaaaaaaaaaaaa

SEQ ID NO: 71 - DNA, 437 bp, Homo sapiens
ctcagcggctgccaacagatcatgagccatcagctcctctggggccagctataggacaacagaactctcaccaaaggaccagacacagtgrgcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttgggggg

SEQ ID NO: 72 - DNA, 561 bp, Homo sapiens
ggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgac

SEQ ID NO: 73 - DNA, 916 bp, Homo sapiens
ggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaa

SEQ ID NO: 74 - DNA, 547 bp, Homo sapiens
agtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagkgtaaaatgttaataatacaaatgtcactgtgacctcctccactgagagg

SEQ ID NO: 75 - DNA, 793 bp, Homo sapiens
tgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcarattgagtaattcagaaaaactcaagatttaagttaaaaagtggtttggacttgggaacaggactttatacct

SEQ ID NO: 76 - DNA, 461 bp, Homo sapiens
accttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaa

SEQ ID NO: 77 - DNA, 642 bp, Homo sapiens
ggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaaaaaaaarawawattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaact

SEQ ID NO: 78 - DNA, 519 bp, Homo sapiens
gcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaaggcgcacatgactccaaaaaaaaaaaaaaaagggcggccgccaccgcgggggagctccacttttgttccctttaatga

SEQ ID NO: 79 - DNA, 526 bp, Homo sapiens
gtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctg

SEQ ID NO: 80 - DNA, 281 bp, Homo sapiens
gttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgaga

SEQ ID NO: 81 - DNA, 405 bp, Homo sapiens
  misc_feature 219, 230, 261, 306: n = A,T,C or G
gtgggtgggagcgcgtgctgttgggagttgcttggaggttggcggcgcggggctgaaggctagcaaaccgagcgatcatgtcgcacaaacaaatttactattcggacaaatacgacsacgaggagtttgastatcgacatgtcatgctgcccaaggacatakccaasctggtccctaaaacccatctgatgtctgaatctgaatggaggaatcttggcngttcagmagantcagggatgggtccattatatgatccatganccagaacctcdcatcttgctgttccggcgscccacttaccccaanaaaccaamgaaatgaaccttggctactacttttcaatcctcaaakcttttcacavhtgaccttccttcctaacattctttmtgataaacatttattaag

SEQ ID NO: 82 - DNA, 547 bp, Homo sapiens
tagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagtkgtcacagtaaatatcttgttttttctatg

SEQ ID NO: 83 - DNA, 529 bp, Homo sapiens
ctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgcccggcctgaatcccatttctacagtaacag

SEQ ID NO: 84 - DNA, 527 bp, Homo sapiens
cccatcaccagaatcccttcatgggagggatggatgcctgttgaaactcactgacctattggactgacgctggggtggtatcttcatcagagctattgtaagtcatccaaaaggcttctgacgaaagaacaatttttaaaaagtccctcttttcaatcaagccaatgtcctattttatttctaaaagttttgggactcgtgctgttatcaagtacaatgaaaatggctttataaatagctgttttgacattgtgatagaaggcttgaatacggaggaaagatgtcgctggagctagtcctgagttccgactgtccctgtggtgggaatccagtctgggaaagcaggactgttttagcaaacgtgtactcgttctataaaaatggaatctgttctgcaggttaccgtccctccccgcccaagcatcccctctgtcctgtctctctgctgctgggacccagggctttttcagctgcagaacccactggacttccaggaatcaaggaaaaagtggaaatgtccaactgtg

SEQ ID NO: 85 - DNA, 401 bp, Homo sapiens
cagtgtggtggaattcccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatcca

SEQ ID NO: 86 - DNA, 547 bp, Homo sapiens
gaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgcca

SEQ ID NO: 87 - DNA, 530 bp, Homo sapiens
atggattcgaaataccagkgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacrtgggaggccatggagaagtgtaaagatgcaggattggccaagtccatcggggtgtccaacttcaaccacaggctgctggagatgatcct

SEQ ID NO: 88 - DNA, 529 bp, Homo sapiens
acctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgt

SEQ ID NO: 89 - DNA, 547 bp, Homo sapiens
gtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccatccaaggaaaataattatttacagtttttgaagtcac

SEQ ID NO: 90 - DNA, 528 bp, Homo sapiens
gagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagttgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacat

SEQ ID NO: 91 - DNA, 547 bp, Homo sapiens
atataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattaraccmtttggscyttgraccttymtwrgraaaawgrmccmacctttyttaacmtgraccwccytmatctctagaagctgggatggacttactatyctkgttwatattttaaatackgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtc

SEQ ID NO: 92 - DNA, 527 bp, Homo sapiens
  misc_feature 393, 502: n = A,T,C or G
gctggctagtaggggaacatgtagtagccaagcccatgcattgcagtgcacagagcaacattggggtaacaggatgggtacctgtcacggcctgtgcaaacataacatgtgtcaccacactgaaggtatggtggaacaagtggcctcaccaaggtcggaccccaatggactttttgcctcttgggagcttatgggtctatgaggacacagtagcctttcctatcagcaaactggagtggatgttgtatctgggggtggccttatgtacctgctactgttctccccacattgcccagatgcctgtataactgggaggcactgkgctctcagtttttgcgaatgtgatgagccccctggtgtttctacccttttggcaatgactatccctggagncatgtgtcaaaactgtaaagcacaatttactgctctttgcggagcacaccgctcatgctctgaattacacctgaktgtccctcctccwgktawtgaatgaggttgatcnvatcagaaadgtggkgttggcmata

SEQ ID NO: 93 - DNA, 531 bp, Homo sapiens
ggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgt

SEQ ID NO: 94 - DNA, 547 bp, Homo sapiens
  misc_feature 547: n = A,T,C or G
gttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtn

SEQ ID NO: 95 - DNA, 1265 bp, Homo sapiens
gtggtcaagcagtgatttttctgggactgcagaagttcctgctgtgcccaacctttattactaactgggaaagacccagggagactgggatgggctcatgattctacatacagaactcatccaagaaaggaggaaaagctgatttttgtgaacgtcgctacttgtgcctgaactaactctcaggcacattagtcagaaaatactacctatggttactcccccaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctrcagcgtggggttgtggtcctggccaagagctacaatgagcagcgcatcagacagaacgtgcaggtttttgagttccagttgactgcagaggacatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccaga

SEQ ID NO: 96 - DNA, 568 bp, Homo sapiens
ccagtgtggtggaattcggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttt

SEQ ID NO: 97 - DNA, 546 bp, Homo sapiens
ttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgc

SEQ ID NO: 98 - DNA, 547 bp, Homo sapiens
tactgggtgccaagctatgtgccaggcactttacatgtattgatttaacacttaacagccactctatattattccctttttacagatgaggcaatttaagctcaaagcatttaagtagacaaccaacctagaatcacatagcaaatgacagaagccagaggcctcccaagtctctctaactccaaaccctatgcttactctactatatcacactaccttgcaataggacaaagggaatatgtggtaaactatgttcccagcatctaaaagccaggagtggttttcatttttctttaagaagatgatagtgtgatttgaaacatatctgaatttcagaagaggggacttttaaaaattgccactcataaggaaagaaagaactttttcacatatttttgaaagaaacgatggtgagaagatattcttgataatagagatatgctaacatttgctttgggtgttttgtaggttagatttttttggtgtgtactttataggcttgcatattgcttactttaaacagctgaagttctaagtaagagtgttc

SEQ ID NO: 99 - DNA, 122 bp, Homo sapiens
cagcctttctgtcatcatctccacagcccacccatcccctgagcacactaaccacctcatgcaggccccacctgccaatagtaataaagcaatgtcacttttttaaaacaaaaaaaaaaaaa

SEQ ID NO: 100 - DNA, 449 bp, Homo sapiens; identical to SEQ ID NO: 10

SEQ ID NO: 101 - DNA, 131 bp, Homo sapiens
ccatgttctctcttgactacgcatatgtgagatttgcccctccgccccgctcgtgatagccatccagatcttttacctggccctgtcttggagaatctgttttcaatctccactgattgcccccttgctgg

SEQ ID NO: 102 - DNA, 199 bp, Homo sapiens
ctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgaaaaaaaaaaaaaaaaaaaaaaaaaaaaaaaaaaaaaaaaaaaa

SEQ ID NO: 103 - DNA, 321 bp, Homo sapiens
ttttttaggtttttaaactttttatttgcatattaaaaaaattgtgcattccaataattaaaatcatttgaacaaaaaaaaatggcactctgattaaactgcattacagcctgcaggacaccttgggccagcttggttttactctagatttcactgtcgtcccacccccacttctttcaccccactttttccttcaccaacatgcaaagtctttccttccctgccacccagataatatagacagatgggaaaggcaggcgcggccttcgttgtcagtagttctttgatgtgaaaggggcagcacagtcatttaaacttgat

SEQ ID NO: 104 - DNA, 309 bp, Homo sapiens
tttttttttttttttatttttttttttgcatcaaaaaactttatttccatttggcccaaggcttgttaggatagttaaaaaagctgcctattggctggagggagaggcttaggcaaaacccctattactttgcaaggggcccttcaaaagtctctgggcttctatttcaaccgcgatgatgtggctctggaaggcgtgagccactttttccgggaactggccaaggaaaagcccgagggctacaaccgtttcctgaaaatgcaaaaccagcggggcggccgcgctcttttccaggacatcaaaaagcca

SEQ ID NO: 105 - DNA, 591 bp, Homo sapiens
cttatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccataggctgtggtaacatttgttgcatgaatggaccgttgaaatagggcctggcagggagaaattcaggaaatgaatgaatggttcttccctggcagcctttgatgacttacaagccccttcaagggggaaagccatttttctccctgggactccttgaaagcccgggagccctgcct

SEQ ID NO: 106 - DNA, 450 bp, Homo sapiens
ctgccactcctgcctctgctaccccgaaaccggagagggagctcaataataacacaggtcccactaaactaattaaggtgttggcataacctgtcattgaattcaagtgtccaacaactgtttgcttaaaatatcattagacctaatatttttttcaaaggcacaaagtttaaacatggggggggcgggtgttgagaggggtctgggatacccttaaacccaaaaaagtgatttgttcccccttgcccagaagggtgactgttccactgggcctgtcaccacaggacattttccatgacaagcactcaccttcttggggaaggggcatcaggttggcacaggaaaggcccaagtgaggggccactctgtacattaatactttggtgattaatgtttggggagaggcaggattctcacccacctttttgacttcaaacactctcactcaag

SEQ ID NO: 107 - DNA, 116 bp, Homo sapiens
tcgacgaaagttactgtcactcagttgtaaatccatcagcttttcacctgttaaaaattttgcaaaatatacatgttctcctcctgttttcaattcttccatcttttttcttgagg

SEQ ID NO: 108 - DNA, 291 bp, Homo sapiens
ctgctcgaagttgtcaaaacccacgtgcagggcaatggagagtccgatggccgaccacagcgagtagcgtcctcccacccaatcccagaactcgaacatgttttgagggtcaattccaaactccttcactttggttgtgttagtagacagggcaacaaagtgcttcgccactgcagtaggatccttggccgcctggagaaaccactccttcgccgtctctgcattcgtgatggtctcctgggtagtaaaggtcttggaggcaatgatgaacagggaggactcggggttcag

SEQ ID NO: 109 - DNA, 662 bp, Homo sapiens
gctgtttccacagtacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaaagacagctcctggaccttgccccggggcggcccgctcggaaagggggcgaaatttcttcaagaatatttccatttccacaaacttggggccgggggccc

SEQ ID NO: 110 - DNA, 323 bp, Homo sapiens
tcctgtgaaacagcccattttcctacctactgtgggttgctgctcaggaggaacgatatacgccaatacaagcaggaaatctgcagctcctctgctatgtgcctcagaacactttcaatttttctggtcaatgctctgattaggtatcatacataaaagccagcatattagtttaaatctctaacaaaaaactatattttccaaagtcattatcatttgggccaattaagtgatcttttcgtgctttgttgagcttcatctttagggcatctcttctttcttcccattcatgaagttcggcatttccatgtgcaaatttacag

SEQ ID NO: 111 - DNA, 336 bp, Homo sapiens
tccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcctaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtgg

SEQ ID NO: 112 - DNA, 218 bp, Homo sapiens
tttttttttttttttttttttccagtcaggagtatttttaatcactgtctacagagacacctacatacacacacgggtggggaatgaacccaaagtttttaggtgaagtctctcagggcccaccccgtgccacagaccttcctcggttgcagagattctgggcaaagcatccgtgctctcatgagattatcctggggagatttagaagaattttgtgg

SEQ ID NO: 113 - DNA, 533 bp, Homo sapiens
ctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccagaaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcatcccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatctaaa

SEQ ID NO: 114 - DNA, 261 bp, Homo sapiens
  misc_feature 43: n = A,T,C or G
ccatatctgctcggcgctacttctttcttggattgatcctgantgatgcattggcgatgcctttggagaaggacatgtgatgtgatggtcttcacgttccacatgtactcgggcaaatagggggacaaactgaagttaaacaggtcgaaactagaggagctgctgaccctggagctgaccactttcttggggaaaaggacacatgaaggtgctttgcaaaagctgatgagcaatctggacaccaacataggacaacaacgt

SEQ ID NO: 115 - DNA, 267 bp, Homo sapiens
cctctcctgtgggttccagaccctgttccagcaacaattgctgggacacctgggccgactgctccacctcgccaggccctggccctctccatctcagccctgacagccacccagtgataaacacagcaggcttcctaagcaatgtgacgcaccagaggggtggtggtacacgttccccttgaagtcatctgaaaattagagaacagatttgcctcatagctgaagagagaccctattccaagcatgaatggccttgacaatgttcct

SEQ ID NO: 116 - DNA, 239 bp, Homo sapiens
ctgatgacctggggtctagtgaaaatgcagggtcagattcagtgggtctggggtctgaatctctaaggcgctgccaagtgatgctgatgctcctggcttgtggaccaccctgtgtatagcaaagctctagactaggaggtctcaaccttggctgcacagaattatctggggagtttttaaatttcccagtgcccaggctgcattcatatcatagtagagacagggttttgccatgctgg

SEQ ID NO: 117 - DNA, 168 bp, Homo sapiens
aaaaaacttttatattgctgcatcttccacagttctttgggtagtctctgaacttaaaatttgtaggagttgtagactacctaaatttttaagttatggatttgttcataggttgtaggggtaggtaaagaaggaaacagacaagaaaatggcttcttgaggtggcag

SEQ ID NO: 118 - DNA, 150 bp, Homo sapiens
aaaaaaaagagtttatttagaaagtatcatagtgtaaacaaacaaattgtaccactttgattttcttggaatacaagactcgtgatgcaaagctgaagtgtgtgtacaagactcttgacagttgtgcttctctaggaggttgggtttttt

SEQ ID NO: 119 - DNA, 154 bp, Homo sapiens
aaactgtgtgagatattaaccagccgccctgttataaaatcaggaaatccaaacagcgatttacaccgattaacacccccttttatattttttcaaatacactgagaaaataatcaaacgttttcatctctcttgtctttttttgttttttcct

SEQ ID NO: 120 - DNA, 314 bp, Homo sapiens
ctgcgtggagtgacgggaggagggaatcactgtgtgtgcgagagtgcttcagactcaatttccaaaataattttcacccctctaagcatgtaaattcaaagatggatccttcatagaaattaaaaaatcaatttgagctcatttcgaatacagaacaagtatggcacagatggaagtcctgccacgtttcctttaatgatgctgactcttgtatcacacaggccagcatgaagtttcttactcagactttacaggcattttccgtaattcaatcagtcctgctcccagcacaacacaggaggtgattcgagaat

SEQ ID NO: 121 - DNA, 601 bp, Homo sapiens
aaaaaaaacctaattcattgaagtaataaccaaataattttcaatcttgattcaactgtgattcaaatcttacaccatttgccccttctatgaatttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgtacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaacgacaaatcacaacaagtgattgtccagggtgtccatgagctctgtgatctggaggagactccagtgagctggaaggatgacactgagagaacaaatcgattggtcctcattggcagaaatttagataaggatatccttaaacag

SEQ ID NO: 122 - DNA, 486 bp, Homo sapiens
ctgtttctaattgcttttgtgactgttaccttttagttcatgcccccccaaagagctaaatttcacatttttacctacaaaattgatttttaattcctgcaaataatttaccattatgagctacaaggtgggcaacagcgcctgaggatctaattttatgcatattactcccaagtattttaacacttgttggagaagcaatatctggatcaataaaacactgtcccatcaaccatttgagtggggagagggagaagctcttctgtaagtaagattctggcaagctctttgaaatgagtcttctttcccacagattttctctactctttcaatacaaacagataggagaagagggaatagaaacctggaggaacttgaatatttttgttctagatagagatacagttattgaaaaggaaacctagaaagtagtcacacgtcgcttatttaggccagaagtaattgtactgggcaaaaatttcactt

SEQ ID NO: 123 - DNA, 239 bp, Homo sapiens
ctggtgggtctttttttcctctcagagctcaagcctgtagtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttcctacataaacaaggcccctttt

SEQ ID NO: 124 - DNA, 610 bp, Homo sapiens
  misc_feature 4, 12, 30, 73, 75: n = A,T,C or G
ccanccaagtcnttgatgatcactgacccncgcgcgcctgctggaccaaggtggctgcggggaaatcgccacngngctttcggttttcttggtgaaggaatacaccgcgccgacagcaggttttcagtcagggtcagggactgttgcttgcgcgcgaaaatcaccggtacgccgaggttcaggccggtcatgatcgccggtgcaatgcccgaggcttcgatggtgacgatcttggtgatgcccgaatccttgaacaacgcagcgaattcatcaccgatcagtttcatcagcgccgggtcgatctggtggttcagaaaggcgtcgaccttgagtacctgatcggaaagcacgatgccttcttcgcgaattttcttgtgcagtgcttccacgaaagcttcctctgttggcgcaacacgcgccgaaagtagattaaaaagtagtcgattctagcgctttaacatcgcgcgtatatccgccagggcggtattgccgcgaacggctttgacttcggttggtgtgtcgtcgttgccttcccatgccaggtcatccggcggcagttcgtcaaggaaccggctgggggcacaatcaatgatctcgccgtactgcttgc

SEQ ID NO: 125 - DNA, 196 bp, Homo sapiens
ctatagggctcgagcggccgcccgggcaggtaaaaaatcagcccctaatttctccatgtttacacttcaatctgcaggcttcttaaagtgacagtatccttaacctgccaccagtgtccaccctccggcccccgtcttgtaaaaaggggaggagaattagccaaacactgtaagcttttaagaagaacaaagtttt

SEQ ID NO: 126 - DNA, 247 bp, Homo sapiens
aaattagttaaaaaaatgcattcctcatttgatatagccacattccaaatgcttaaaagccgcatgtatctagtgactaccatactggagagtacaaatatagaactttacccgtcactgcagacagttctgttggattgtgcagcattggacaatatatacagtttgcctgtatatgagaaagagagagagagagagagtgtgtgtgtgtgtgtgtgtgtgaagtgcaataaggctgacaggcatc

SEQ ID NO: 127 - DNA, 590 bp, Homo sapiens
cctccacggcatggcgcaattgttgttcaggggccgccaggttgctgcccatgccgatgtagatacgttccacgtgcttactcgccagacgcactcgaagcgtcgccagcgctacgtttgcgcttgctgccactgctgcggcgacgctttttcgggccatcgccggtggcttcgcctttgctgctgagctctttgatcatctcgcggcgctggctgtcgttggcgtcctggtagtcggtccaccactcgccaaggccgtcggtctgttcgccggcgctttcacgcagcagcaggaagtcatagcccggcacggaagcgcgggttgtccagcaacaggtcggcacgtttgccgctgcggcgtggcaggcgctcctgcatgtcccagatttcacggatcggcatggtgaagcgtttcgggatggcgatgcgctggcattgctcggcgatcagctcgtgagcagcttcctgcatggctggaattgccggcatgccacggtcttgcaggcgcatgacgcgtttcgaaagcgcgggccacaacagggcggcaaagaggaacgccggggtgaccggtttgttctgcttgatgcgca

SEQ ID NO: 128 - DNA, 361 bp, Homo sapiens
ctgcccatggaaaccctccaggagctgctggacctgcacaggaccagtgagagggaggccattgaagtcttcatgaaaaactctttcaaggatgtaaccaaagtttccagaaagaattggagactctactagatgcaaaacagaatgacatttgtaaacggaacctggaagcatcctcggattattgctcggctttacttaaggatatttttggtcccctagaagaagcagtgaagcagggaatttattctaagccaggaggccataatctcttcattcagaaaacagaagaactgaaggcaaagtactatcgggagcctcggaaaggaatacaggctgaagaagttctgcagaaatattt

SEQ ID NO: 129 - DNA, 546 bp, Homo sapiens
aaaaatacaaattcagtaagacttttgctctaacaacaatttttcaaaacgaatcaacaacaaaaaagtatccagtgtttcttttcttatgaagatataataaaacacagtattggtaagcacattttaacagtatgcttttcttttgtagggaaaggagatatggctatgtctaacatcgtgggatccaatgtgtttgatatgttgtgccttggtattccatggtttattaaaactgcatttataaatggatcagctcctgcagaagtaaacagcagaggactaacttacataaccatctctctcaacatttcaattatttttctttttttagcagttcacttcaatggctggaaactagacagaaagttgggaatagtctgcctattatcatacttggggcttgctacattatcagttctatatgaacttggaattattggaaataataaaataaggggctgtggaggttgatattattaatagtgttatgcagaaaatatgaatggcagggaggggcagagagaaaaatccatttcttcattt

SEQ ID NO: 130 - DNA, 733 bp, Homo sapiens
  misc_feature 611, 631, 668, 689: n = A,T,C or G
ggggcctcttcctaaaggcactaatcccatccaatagggcttaacctcatgacttaatcaactttcaaagacaccacatcctaatgccatcacatcagaatttaggcttcaacatatgaattttggggggacacaaacattcacctcatagcattcattgtttcttgttattggcaaagccaagactcacattgtctaagttatttgacttttgagtccgcagatgtgaaaacagtgctaaacagtccagcttcatgagtggagaacagcatttgtgacaaccaccaaagtacctctgtggtcagtgtcctcaaccagggcacagcatcatggaccagagcctctgcagggcacagaggagtggtgaggaacaggggctctggagcaaccccacttccctctgctttgtatatggggggttctgcacatgactgcatttgaaaagggcttcactgcgcttgctgaaggagtgcacttgagctagcggagagttcccagagggtgtctggaagaagcaaaggctattctttgtttcactcagttatagatggaagtcagacacttctgcctgaagtactttcacacactccacagtcttaagaaggatgganaaagcatgccaactactcanaaaaccacaggtgttcaagcaatggtatccttttatncctacaactagtggacaaagnggggcctctgtaatttgggaaagctaggaaaactttttctgggg

SEQ ID NO: 131 - DNA, 305 bp, Homo sapiens
  misc_feature 16, 19: n = A,T,C or G
aaacacatacgaatanttnaactgtgattatgaagtgacagccggctaaatatgtcttgtattttctctcttcctttttttgctaactcatcctttattccattcctgcttccatggtaatgcaggctcaaataaattactaggatacaagattacttcaagcctcttttctgtggaactcataatatgataagcatttgttacaagattgcctgtagttgtttaggggacaaattatattagggaaagaaagtctttctttagttggttaaattttctattataattgggtactaaatttattt

SEQ ID NO: 132 - DNA, 545 bp, Homo sapiens
aaacaatgctacactcatttttggcaaagtgctgtattgttcagtctgtgtacaaaactgaccatctatgaaccaatcagtataaaaaatttctataaaaacaaaatttagacagcggctcaagaaaacaagctgccatttatgcatagattgatgtacagtaacctaaccaaatgtcccttttgaattttcaagttactgaaaaaaaatgtgtcgagaaacacattaagaaggcacatgtacagtctacaatactcttcagtctccctaactcatgccctgcccctataaaggaaatatgttcacaattttacttgagaaaaaaaaacaaagccacttaaaaaaaaaaaaacacacacgcaattattaaagttcaaaatctctggaggaaaatacaagcaaaaccactcatacactccaagcctgaaacacacatctaacctccccaggtactggtttggttttcagaggtccacctagaaaacaaatctaaaacttcaggcaaaacagagcaaaactggacatttaacaattacacaattttt

SEQ ID NO: 133 - DNA, 330 bp, Homo sapiens
  misc_feature 36, 68: n = A,T,C or G
aatatttattactaatatcttataatgttttgtggnaccatggcataccttgggtactattgtaacanatagttcaggaaaccctactataaggtttatcaaatggtctcataaacagttacttattcaagcacgccaaagctcagtgaaaagtatttttcacccttactctttctcgtgtcattcaaagagaagttttgatgtagtgtatttatttgtagggagtaatgaacagatccatttcacagtagactttgtgctctaggtgatgcagctaattgccccagtttggaaaacatggacttggatgaattgtcttttgtttgggac

SEQ ID NO: 134 - DNA, 627 bp, Homo sapiens
  misc_feature 99: n = A,T,C or G
aaatattacttcaaatacattttaaagctcaacaaacttgtgttgaactgaattgcagatcctgaactctatttgaaaatacatcatgaaacagaaaancccattccaaatgaaaatgatagtgctttgttgggggtgggaatgaggcggggagactaaatcactattaacagacttcttttcccaatgcaatttgtcaaaagttcaaaagttctgaaatgtactaaatcttaagcaaattaaattcatgatattactaaaactttttaaatagtgcaatgacttatcaagttatagtggctgcattaagaacaaattattgtgtgaaatacctgtataaacacaaaatacaattaaatatttctttacaaaaagctgagcattacgcataatagtggaatgtctttcattaggtgtattttttaaagattaacaaaagtaacatttcctaaaatgtatacatgtgccatatttttgcaaacatgcctgagaatgtatttaaaacatttctgtagtaagagtttgcaagaacttcacaaacctgcaaataaaatgcatctttttaaaaaggtgaaaatggcatctccacactgcaacaattcaaaaagtgcagcatccctaatcttt

SEQ ID NO: 135 - DNA, 277 bp, Homo sapiens
  misc_feature 45: n = A,T,C or G
aaaatcaaatatattatttgttaaaaatcagcttgtttcattacnggaaattacaccagtccgttctatttactttcaaaccatattcaactcctcaactttcaaacatgtaatcaactaatttcaaaagggaaaaggtaccctttataaaggagagatctgttaagacaccaagaaatcaaaattaatatcacttaataattaagtggataacacatgcctcccaatacagtgcagtgagaaacacaaaacatcaattcccgcgtactctgcgttg

SEQ ID NO: 136 - DNA, 486 bp, Homo sapiens
aaaacagaatgaattcattgttacagttacagaagtcagaagcccaaatacagtctgcctgaaccaaagccagggtcagcaaggttcctttccactgttttgccaacttctagaggccacctgtattccttggttcatggcccctctcttcatcatcaaataatcagcatagctttatgacattggcagctctgattttgctcttttgccttcctcttatgtagacccttgtaattacattgggtacacccagataaccccaaataatctccctatctcaagattcttaatgtaattatattgggaaagtcccttttgtcatataagataacatagcaatggattccaaggattagtatgtgagtttcttttgaggggctataattaaccctaccacaatatggaaatgtctattgtttttctatgtaccagaaataagacattaggatgtgaaattaataacataacaccacttacggcatcacc

SEQ ID NO: 137 - DNA, 552 bp, Homo sapiens
  misc_feature 310: n = A,T,C or G
ccatcttgcatcaaatgttcttaaggcagtgactggctatcaaccacagtttctgtctccccagttgcaaacacaggatccatgcaacagttctgagaccatacacttagaaaccacaggggatgcggatcaaatgcagaactcccaaattataaaacagtcaggctacactcaaaacaaaacatagaacatcaacaacacacatctcccaaaaaagaagtgcaacgcatgcttgtataaaccaacaataacaaaaaaaccacaataaaaaatgcagagtctcccaaacaagttttcaaatgtattgcanaaagaaaaaaaatgtatatatatataaaattaaaaagtctgaaatactagtgcatagtcaattacctaacaccaagtttcttttctttctgtccaagctctactgcccctctgatactagcagcatgtctacaggctaagaccatagcagcaaaaaacgtttttcatttggcatttacaaaattaaattactgaataaaaatataattttttataaaactatttcttacagtaataattttt

SEQ ID NO: 138 - DNA, 231 bp, Homo sapiens
aaattttactagtgttacttaatgtatattctaaaaagagaatgcagtaactaatgccctaaatgtttgatctctgtttgtcattactttttcaaaatatttttttctgtaaagtataatatataaaacttcttgcttaaattgaatttctatattagtggttaattgcagtttattaaagggatcattatcagtaatttcatagcaactgttctagtgttttgtgttttt

SEQ ID NO: 139 - DNA, 535 bp, Homo sapiens
cagttgccaaccctctgaaccgtttaggccggttcatcgctgcctttgaatctgggccggtggtgatccggcaaggggtgaaaccaaagagcgggggctgtgaggcccttcgcagtccctcgtaagtcgctgcgatggagtgaactatcacgcatcgtgtttatttcgtcaacacgaaatgtgatttatttttgcgaattaacacggcagttctcggttacgttttcggaaagcgtgggatatgattctgtctatcctgtacggatatacagtaattaccgggaggggattccatggcgaagaagcaggcggcaccggcagcacggcaggaaatgagcggtatggcgcgcctcgggcttcgcgtctcatcgatgattaatcacccggtcgcccagacgcagcgctgggttacgattcatcgcctggacacggatggggatcgggagtgggaagaggttctgagcgtgatcgctgataccgacgagctcgagctgacgctcaatgacgatggcagtgtgacggtgaggtgggagca

SEQ ID NO: 140 - DNA, 640 bp, Homo sapiens
  misc_feature 557, 559, 591, 599: n = A,T,C or G
acattggtggcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctaggttagtacaaactcgcattcatggcttggtttcccagaagatctccatttaacttttttaaagaaagtttattgctttctttaacctgcattttttctaagttttttttcgcataaaggtgctgtctttgtggcaaggcctaggcatgacaatcggaggactcgagggggatggaggactagtgatccggctggctgcttccagtcgattagagaggtgaaaaagctgaacgtgtgcccantnaatcttcaaaaaggcagaaacatatcaccttntgcccccntaaacttgttctttttccgaaggggaaaaaaaaaatggaaa

SEQ ID NO: 141 - DNA, 127 bp, Homo sapiens
aaaaatcacacactgacaacacagaaatacgaaatgctaggaaaagtctagcatatgaaggaaaaacatgtcttatgcactctaatataattttttcaattagtataaaggcaaatgcggttttttt

SEQ ID NO: 142 - DNA, 126 bp, Homo sapiens
  misc_feature 18, 44, 46: n = A,T,C or G
aaatatcctctggatgcnttcaagtaatactaatcatttcatgngnaaaagtcttttaataaacaaattcagagtaaaattaattgaaatatttataatacatttgttacacagttatttccaata

SEQ ID NO: 143 - DNA, 730 bp, Homo sapiens
  misc_feature 512, 555, 603, 608, 685, 721: n = A,T,C or G
gcaagttctggagtgttcacttctgagcctgaattccctcccctgcaaaatgggggaataccctcctcagagggtccctgcgagggtgaggggagatcagcatggcaggtgtgctgggcacggcagggcctgggaagggcagatcctttccccatccctgccacaaacaacccaaacctttaaaggagagcaatggccttgtgtcaaaaacaaaaacaaaacaaaaccctgtcctaggagactggggccctaatttctaatagcaagcctttatgagtccctaacactctactgggctgagtatctcacacgccagaggataacctgccttctgctcaccaccaccccgtagtagttgtcattgtgtccatttcacagatgaggcaaaggctcagaagagtcatgtgttaaaccagcttctagagcccatgcaggagctgcaggtggggagaatcacctctaggtgctcttcccatggaatcctcaccctccttgagtggtcactcactcanctttccaatgggtgtgtgacctttgaccagctttctttccttntctgggcctcagtttcccaccttggacaaagtaagaggtctcttgggnttcanggtagttcttcctaacttcttttccttttcatttgagcatccttcttcattttttgccacctctcttgtcattacangcttttaccttcggccgcgaaccacgcttaagggcnaaatttcca

SEQ ID NO: 144 - DNA, 485 bp, Homo sapiens
ctggtcagaaatgattctcttgtgacaccatcgccacaacaggctcgggtctgtcctccccatatgttacctgaagatggagctacctttcctctgtgtggcattttgtcgcttatccagtcttctactcgtagggcataccagcagatcttggatgtgctggatgaaaatcacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctgcaacttctggaagaggagaacaaagaacgtgctaaaagagaaatggtcatgtattcaattactgtagctttctggctgcttaatagctggctctggtttcgccgctagaggtaacatcagccctcaaaaatattgtctcaacag

SEQ ID NO: 145 - DNA, 465 bp, Homo sapiens
ccaagacagctcgtttctggagagtatgagggtgtgttttcttattgtgaaaggaactaccttctcttagagggtaggaagaatgtggtgtgtgtgtgtctcataaagcaaccggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcattttttttttcttaacagtcaaggggaagagtgattcctcacactgctttcaagctggactgagccagtctcattctgggaaagaaatgctgtgtccagaactcagcagctccatctattttttccagtcgaaagaaactgatctttaggcagtttttacttgg

SEQ ID NO: 146 - DNA, 351 bp, Homo sapiens
ccagccggggtaatctgtatgtggcggacttgagctacgacgtgggcggcaagtgcctgtttgaccagatcagcggcgtgaagcttatgccaactcatcgtttgataaatccgaggatcagttcaagacgtcgcagcgggtgattttgggaacgtcgttttcggtcagtaaattgtgggtagcgacggagtggttgatcggcaagaatgatccgtatattggcgggagcagctataccgagagcctgggggctggggggagtaaccagtgggagaatcagttatatatgaacattgggtactacttctgacttaagatctccagcgttttaactggccttatcgcaggcaa

SEQ ID NO: 147 - DNA, 654 bp, Homo sapiens
acttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattatgctttacagtgcaggtcttagtttttcttttttctcatttcttttgaaatggcatctcgaacaaagtccaccaatccctttacaaaagaatgaactgctcctctgtgtgtacttcatagaaggtggaatcggacagaggcaggttagtgacagttattcctgaaatacaggagcagagtacagtctgttgtggtttcccggattccgcgcctagctcagccaattaagcatgagacataggccattgagccacttagtagttatgcgagtggatagattggtatgtaagagggaaagaggtctgctgtaaagaacaacacttgtttgtctgtggggaaagaaaagcagaatcttgagatgaaagttggcatacaaataggatactatcgccagtaggttatattacaaaacatttatcggg

SEQ ID NO: 148 - DNA, 539 bp, Homo sapiens
tgaatatcatgagggtgattttcacctgattgcaaaactgccatagtttgaaacactttttcaatttaccagacacactctgtcaagacttcatatacttccaacttgcaagcctgtgttttgccttctccaacctaaaaaggaaaagctttaaacgatgaacttacattctattaaaccatcagacttgagcttatccatctgtttagcgtgaatgtacaaaccaggtacatttccaccaaacacatagaaaaatcttgtgcatcacagttcagctaagggtagtaggacaatccttacaatcctccttggatttcttttttaagatgtcaaagaagcaggtaagcaacattgttcatttgttactgggtgttctagatcaaaccttcacaagctatatatatagcttcatatgctatagcttacaaatggggtaacaaagtaaaagaaaagaacaaattatactttgacactttatagtcaaagtataattaaaaaagaaatcctacagtgggtaatggagaaatagataatttttc

SEQ ID NO: 149 - DNA, 273 bp, Homo sapiens
tttttggtcattctcctcaaggagccgctggatagtagtcttgattgacttccaccttgcccctcatacagtccggtactaaggccaccgacatcccgaggaacctccggaaccacgaccgccaagcaactcgacccacgataggtggggcctacgctctcgaagttgattggatgctcccgcctacagggcggggtacagaagggacgtcatttgtgactggacgcgcaagagctatactcagcagctttcctctgtcccagcccctagaac

SEQ ID NO: 150 - DNA, 200 bp, Homo sapiens
gtttttactaccgtatggcccatttaaaagggatgtgtacgccttacactataacccttaaaccacctagaaatatgaaactcaaactgccactgacctccctcaccaagctccataaaagtaaaaaattataacaaaccttattaaccaaactgaacgaacatatgggcgattgattcattgcccccacaatcctaggg

SEQ ID NO: 151 - DNA, 515 bp, Homo sapiens
ctgtagcgatctttaagaatattttatatatgaaatctggatttagggttcccatggtctggcaccactgggtacagtagttctacatggcagtaattcattggagttgaagcagtgaggaaagagtcaagtactagtcttttatcctcagtgtccagtgactgtcaagagaaatgggactgccttctgcattgggatatgtgggttaaagagtagtccaatatagaagagtgagaaagtgmaccctctgaggcatagtaatgttttattkraaaacatctcacatgtattgaatacttasataggatgtattctgtattactgaattttccagattattgaagcaatcacctttctgtgtttaaagttttagaaagaatgcttttaaaaatgcttaacataagataagcctgttttcatggtgcaaggtcctttctatgaacatgaatcactggactctgagggttggactaagatcacatctacatcccttttaaatgactagtgtgctcaga

SEQ ID NO: 152 - DNA, 243 bp, Homo sapiens
atttcaacaacatacttgtcgaggtagttataaatcttcttagggggaggtggtggtttctgttggaatgccaattttacagcttctgctgctgattcaggttctttaattatgcttttctttgagtctgcttcagatagcacaacaaaaaaatgatgacacttttcacacttgacaaaacgggtggatgatacaaaaggtctctacatgtgtgcacaagtcgccacatttaggacagcgcag

SEQ ID NO: 153 - DNA, 620 bp, Homo sapiens
ttgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcggatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaacactgtggataatgacaaaaagcataagtaaaaatattttgagaaaaataaagtacaagttttgaacacccccc

SEQ ID NO: 154 - DNA, 843 bp, Homo sapiens
cattgttagtgacccaagtaaatttatagtttttaagttcagaggaaaaataaagcctattttttgttaacagtcttaataaataataaaatggaataaagaaaccaaaaaaaaaagaaaaagtttgtatgaaaattcatccctatttctttattttggactaagtagtcaaatttctactatattaatattatgtaagcgacacccatttaaattcactctctttgatagaaaggtgagttgattatcacacctgctattttttcactgccaaaragactgcaataacctccctccatcaccctcaaaaaacaaacagaaaccatctgaggcatagccattgtttacatattgtgtttgtgtgcacctatctacaacgttctttcttctaaggagtttatctgccaatattttcggcttcagcagcagcgctcttcttgacagactaagagaaggatctacagaaaagtcatctgattaaggttttgggtcaaattaaaactctctggacagaatcctctttccttcacttggatttctgcaaacagaaagcagattattctcctggcacaatagcgactctagaaacgcttatgtttttcagactttggcagaacttgttaagaacagcatcatcataatacatttgtacaaactcgaatttcagtggctcttttgtcccacatgatgcatgatgaaatttataaaggtctgttttacccccacagggtcatttcttttgtgttcctacagagccaataggcttcatttaagtccaagttattatattaaccatccctttcactagactagagaacttctttttcatggtccatatcgtga

SEQ ID NO: 155 - DNA, 674 bp, Homo sapiens
tttcgtgtcagccccaggtttgctccagctattcacaagcagaatataacacaagaaaaacaattcatatcccttagggaaaaaagaggatcaattcatcactcaatatttaatacagccaaaatgagctgccaaaacaagcacacacacaaatactgtgaacagaaaaatacaagaaaatgactaagctgggagtcttgacggggtatggacattgcttaaagcacttatcagtccccagaaaaaccaaaccaaaaacattttttacgatggcatggcctcatggccccctttaaaactgttgatggtaacaaagggcagggggtggggagagaaaacacaatcactgctccctttttgctcgccagtgtgactgcacccctcacggcaccggcatgtacacaactaccacacaaggaggaccaagtccctctgctggtggcctcctaaaaggcaaggcttgagttttggctgatgagcaagttctctccgttaccaatccctgccaaccagcactaccatggctgaattgatctaccgttttcctgagtaaactgtaactggctacagtttcggtaacatggaaaagaactcagctactacagccaactgcaatacttcaggaaccccctccatccctggggctcctcactcctagtgcatcttgattggat

SEQ ID NO: 156 - DNA, 671 bp, Homo sapiens
cctttagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtgggctggggcacaacttttagtctgaggggagctagtagtcggcttgacaattaaagccatccataacaacttttcctcaaatgtgttgactcctcaggggctaaactgctcttagcttagaattatgctttactagagatctaccatataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacattttgcagaattgcagattttccc

SEQ ID NO: 157 - DNA, 474 bp, Homo sapiens
cgcgttctttaattctttaagcctagaaagtcctttacactacttacctaaaggtcccaaagtaaaacacacactagtagtaaggctagtgcatttcccttctagcactcaaagaaagcttaacatttttgacagtttgcaaataccgccttgtatttctgattcagccttattcaaagtatcataataaaatatttattaaatstatgttgatctgcgtgcatttatgatctccagattaacgttaggcttctctgttgggccctaacttggaggtgcttttttggatccctcctcccgtgattcattgtaatttcatttcccttgtcatggctctgaccagagaagattctaaatatctgcccccaaagccaaaattatatcttttgaaaagtgaaatgaagagttgagtcastaatttattttagatattactgcctaaaacaattccccaaaatttatggaagttggagg

SEQ ID NO: 158 - DNA, 584 bp, Homo sapiens
ttggattctgcagttccacatcattcactccggcaaaggagagaacttgtaacaaagatgagtgccaagtttagtcaatttaccctacctggaatactatatacaactctgggtctcatgtgtgttaaaatacatacagtgaagctgaggaagagccactgaagtaaaaagtattgtttacaagttggaaaggatgtaaaaataatctaaagtatactaagtcaggaataaaaggcagagttaataaaattgtggctggtactgatagacgaaacagatatattttctaaatcctggaataattattaaaaaattttacatgtatcaatggattccagactccatattttaagtttcacaactactgtcatttaaaactataccttattgaacgtctcccactctcaataaattaccccaaatcactcttctccaaaacgtaaatttggaacacactgacttacaaattttgggcttaatttataggatgttgtggccctcaaaaatatcattgtgggctaaacaaaataaattcttgaaacaattctaaaaatcaatcattgtccaaaatgaactttttctaa

SEQ ID NO: 159 - DNA, 671 bp, Homo sapiens
cctaattttattacttttcttgccactgctattattgatagaaatacaattaaataattaagatgaaccaatccattggaagattactaaaattgtatcttcccaatgcctcctacagtaagatttctttataattataacccttggagacaatttgaactttatttaaatgttctgctcaaatctaaatttccttctcctaggctgaagcctgatctaaataaggaagtagttgggatatatccacaggctgtcgaacatggagctgcatctgagagacaggtggcagcaaccaaaagcaaagcagggactgagaacaggcaggttccaagagcaaaatggaacttgaaagccaagtatggttcactgtaaaggagaaaatatagaaatacggaactagaacacctggtctgggatgtggtaagcacccaaaatataggaaaactgtatgaattcttgtgaagcagtaaactatgatagtaatcatgtgacacatatgataacaaactcaaaacagggaaaagaggggctttattcaatgctggagataagtgaaaaaaaaagtgaagtgtctcaaggacagaagttatcatctcaaaaaggcatatcagctagatctcgcggaaaccatatgattatcataattctagactctgttcggtattacaaag

SEQ ID NO: 160 - DNA, 315 bp, Homo sapiens
ccagagagggagggctctgcttcaccacagggcaccagaagaggactggtgcgcgggaagaccaggtaatcataatgctattaaaaatagcagtaatcatactgttttatacattgtataatgtcataaggattttaactttcatgtaacataattgctgtaaaagtttccccagtttgttttgtgctatttaccctggtgttaaaatgtgtaagaatttacattttaggtatgttaggtttattcctttttatatggtttctgtttgaaattttgattttagaagacattcattctcaaggtcataaaacacac

SEQ ID NO: 161 - DNA, 607 bp, Homo sapiens
tttytgtgtcaccttggataattgcttaacttttaaaatttacgttccctcatttccaaaaagggattataactcactgttattttgataattgagataaatgtacgtacaagtgctttgaaactgtaaagtgcattataaacagagggatttaccatagaggttctaccttgatgtatcaagagaagccttttctggaatctggtgcagccttgtgagatgctgttaggtaaggggactccttggtagaatttcttacatttgtgtaaaaagttctggttcctgagtaattccaaagaagatgctatgaggagttcactgtgcctttgatttgatcccaatgggtcagaatatgttttctcattcagtaggctactacaggatttgaagtagaaaaaacagggtccagtgaccttcacgggatcctagatgttcatgaatttcaatcatttgagattgtggggtgtggtccaatgctgctctcaaaaagatgttgcctttcttcasagagcattaataactaaaaaatcccctggtcccaaatttattgtgtgtmtctgaaggctttaactgaagaaatgaaawgcacactcatggaacaaactaa

SEQ ID NO: 162 - DNA, 443 bp, Homo sapiens
tgagttttgaaaaagtgaataatcaaaaggaaaataattccttgttgttcataaattaagcatcactaaagtctcttgaaaggcatttctgtattgggcaagatttaaaatactaaagccttaggtcctattcatatttaaagtagcatgtttgtaacctgttactatttggagagagaagcagttgcctgccacaattgaagactacctttcaaatagcaaaagagagagagaaggctgatatttcgggcttttaaataaagatttgtgtggttctgcttttactgtaactgtcactttcccagtgaaaatgatttcatatacatttgagggtcttacasgtatgggtaaagttctataaattgcaacaaaatgatacccaatttcattttatcctttttgtattgtgaaactggaaactttatgacattgtaaattatcag

SEQ ID NO: 163 - DNA, 686 bp, Homo sapiens
caggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatcccagaacttggatttagcatatcaggtggtgtcgggggtagaggaaacccattcagacctgatgatgatgtaagttagctttgtatattcttgaaacacctataaagttttatttaccgattgaatacttaaatgtaagtgaaaatctaatagatgtttatgtaaatctaggtagacatcacctggattccccactctattgcttacctttttgttttgtaatttgatcagttcaagttaaaacaatttaaccaaaaactatgaatgtttatgatataatgaaatgattgttaactttcttattgctttttcacacacctataaaagtaattttattactcccaagagaaatcactaaaggcagaattactagaggtaaaaataactagggttggtacagtattactcaggagaagtcaaggggagaaaacttgtcccaatgattcaaaataattttggcatggggggggggagggaaaaaaatttggcttccttt

SEQ ID NO: 164 - DNA, 706 bp, Homo sapiens
ttttttttgtttcatttgctgcttaaaataaaaattataaattagatttaaatggagcactaattataaaacagattgcaagtaccaccatttgaaaaaaaaaaaaaaaatcagtggatttccataacacagaaaatgcatggacatgcatctacagtagagttaaaaatttcctgtgactaaaaaattaaaaactggaatcaccagtagcaaatgtatagtcaatggctatgacaagaacagatcctgccgagctcataaatgcaattattggcttttttgctttataaaaaagacattacatattttattgcattattctcctaataaaaaacatactaccacgtagctctccccatccccattctttgcttccagatttttatagaaaataactgttttagtctggccttggaaagtgaacccaccagcaccaccttcacctactcactcttcaattcaatatgcacatagcaaaagccaacacttcaaatctcttgcccacatcaaaaaaagtagtttcaggagaaaaacattaataccagttgaataaaaataagggcataaaagctatgagagagatagctctgccatctgtctctgggctaaaaatcaaggctaactattgcctttggcaccacaaggttcaaggtccatggttttattagaaaagtccccacaaaaaaattaaacccccctcacccca

SEQ ID NO: 165 - DNA, 427 bp, Homo sapiens
tyywgggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaamgtctcaggatacaaaatcaatgtacaaaaatcacaagcattcttatacaccaataacagacaaacagagagccaaaatcatgagtgaactcccattcacaactgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatggtgaaaatggaaaaa

SEQ ID NO: 166 - DNA, 124 bp, Homo sapiens
accatgttttcgttgtgtgtgagcagggaagggaactttcctgccttatttaaacctgggccgaggattcgtggaatctgcttgatcagagactctgaggccaaaaacgcatcatacttcttgg

SEQ ID NO: 167 - DNA, 232 bp, Homo sapiens
tctgcatagcaaatatgatttaagaatttaacatcattatttgatcacaagcgtaaatatgtcaccataaataaatgtaaattcattgtacaaaaattcccaacaactcttaatacaaatatggtacatttgacagtttctgaaacagattatttttaaaactttttaaaacctaagctttatttttttcctggttattagacacacacaaaaaaaataaaaagaggctggg

SEQ ID NO: 168 - DNA, 677 bp, Homo sapiens
tttcacaattaaccaacatgcaaaaattctcagactaaacactgagaaattcttcatacaatgcatttgccaccttattgcatttttaaaatctttattctatagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattattaataaaataaaagcttatttttgtttttgctgtggataatcggtacaaaacgtttccagatctgagacttaaatggatcttttaaggtgaaaaggagaatgccaggttctactgaaat

SEQ ID NO: 169 - DNA, 635 bp, Homo sapiens
ttaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaaagagttctcggcgggcgaaatcaccccctggtcactcacatggtacaaaaatggctttgacccgctaccgacagatccggccgggtacatccctgtctgatggagaggaagatgaggatgatgaagatgaatgaaaaaaaaaaaaa

SEQ ID NO: 170 - DNA, 533 bp, Homo sapiens
ctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctgaagaccctgagttatctcaattgttcacggttacagatggaactctttattattgaggagttccactctttcccccatttgtcactactacacttccctagtctttaaaacaattttaggctgggtgcagtggctcattcctgtaatcccagcactttgaaaggccgaagcgagtggatcatttgaggtcaggagttcgagaccagcctgga

SEQ ID NO: 171 - DNA, 568 bp, Homo sapiens
cccttgscaaactttcccttaagtattgcactacaagtctaagacacttttcactcaaagttccttccttccttacctctcttttaacttggagtcagactttcatcagtctgacaacttctccctgtctccttccttttccccccttcacaagcatttcacctaacaaatttcttatgtgcttaatcccctcttagaagcagatgccaagatgggattaagcacataagaggtcctggactaatacaatgacaaaggctccccttgaagcatcacactaaaaggaaaaaaaaaaaaaaaacctagccattttacattaactatttctaaaatatagtatttgcttccctatttgctaaaacaaaatatactaaacatgactattccaaaaatctgtagggtactaagaatatgaagagattcactctacttcaggggatggagttgtagtagaaaaggctttgtggagggagggtggtgtttgaaatgtactttaaaagccatcctcaaagcctcgagggctatacctggcctggtgattatccaaggacagtccattcaaacaggg

SEQ ID NO: 172 - DNA, 167 bp, Homo sapiens
ccatttacaggaatcagccacttcagttcagacagctttattaaaccgcctggagcgaattttcgaagcatgttttccttccatacttgtccctgatgctgaagaggaagttacttccctgaggcacttgctggaaacaagcactttgccaataaaaacgagagagg

SEQ ID NO: 173 - DNA, 391 bp, Homo sapiens
cctcccaaagtgctgggattacaggcatgamccmccmcgccctgatgatagacacgtttttaacttctaaaaatatatgatcatgattgtgtctgtggagacttgcacatatactaaattttaamcaattagagatatttgttcattaccacattttgggagtcattatttcctctatgaagagagaaaggaatttgatacaagttcacaggggcttccagtagattgagacttttatttctagctgagctgctgatgtatgaattttttttgktattatgactttcatatgtattaaaaataaaatgaaaaaacaagggattaggtgaggaacctatacgtctctaatatgcaaaataccacagaaataatgactgktgggaaaattagg

SEQ ID NO: 174 - DNA, 474 bp, Homo sapiens
gaactcagagagaggattgtcacccttggcatctgagctgacactataaggacaatgaggagtctccttggggatagatggggagatggaaggacgatgcctgtcctacggggtcttggaaggttagggatacacactgtgagctgccacaggctcaacagtacggatagggggtgctggaaccagccagggctctgatcaccaagctatgtgccccatgcagaggaaggggtagtggcacactgaaccacccagccacaaggctatctccccatacagggcacctttaaaaaaattatccttacaggggaagacggggaggaaggatgaactgtgtgcggtgatgttgcagtgagtgtgagtttgtgtccgtccgcttgtatgagggcctaccttttactaactagcccccaactttcattatctcccctttttctgtctacccttctgcctttttaaagtggcttgcaatcc

SEQ ID NO: 175 - DNA, 655 bp, Homo sapiens
ccttgcaggggtggggatgtgtgggcttgttcactgttacagcccatgtatacctgaagggcaacatgtacccacaaatgttccaggaggtaaataaaaaatacaattcagcctcttctaaaccatccttgttgatatctctgctacttccgaaagttaattcgttatttggactccataatttttcctattaattcaccctatgtccaactccaacagtgaaaaaaatttatttaatctttgcaataagcctataggcaggcagcattatcctcagtctgcagataagctaaggctcagagaagcttgtatactgtcacttaggtagtaattgcaagagctggcattcagacccagactgtgggactcctcactccattctctttccccccactaggctgctccttaaaatacaatggatgcttgatgaacgcttgtgggaatcctgggtggacacagttccttttcggccaaaagcaccttgacgacttgtgaagaattaatctggaaaacttaacctatttataaaaacgtgttattaagggcaggttattcccaccccctttaccaaagaaacccgccctgacctttttttactgggggttggtcttgggcattttcaacaaggggggaacagtttaaaaattcccccctt

SEQ ID NO: 176 - DNA, 660 bp, Homo sapiens
cctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcaagcacatcaatgccttttccacccttcttcatcctttccacactcaccgactgccattaccaaaacgccaagcacaaccggtttggaacaagacgcattccgttttaattaaaaccaactcattatgtattttagtgggggggaaggggggcacaatcagggttttcaccaccaaattttccacacggtttctgaacaccattgccttttaaaaaactatttttccacctccaaaatatttatttaaattttatttattacggaggtggtattcttcctttgggagccaaattgggaaatttagggaaccttttttattacccggttttttgggcgggtaaaccc

SEQ ID NO: 177 - DNA, 459 bp, Homo sapiens
ctttttctcttcctctgtggaatggtgaaagagagatgccgtgktttgaagagtaagatgatgaaatgawtttttaattcaagaamcattcagaamcataggaattaaaacttagagaaatgatctaatttccctgttcacacaaactttactctttaatctgatgattggatattttattttagtgaaacatcatcttgttagctaactttaaaaaatggatgtagaatgattaaaggttggtatgatttttttttaatgtatcagyttgaacctagaatattgaattaaaatgctgkctcagtattttaaaagcaaaaaagggaatggaggaaaattgcatcttagaccatttttatatgcagtgtacaatttgctgggctagaaatgagataaagattatttatttttgktcatgycttgkacttttctattaaaatcattttacgaaaaaaaaaa

SEQ ID NO: 178 - DNA, 720 bp, Homo sapiens
ctgcaagctcccactccttccatttatcttaacgcccaggctgacttctaagctgcttttcactttcctacctccactgcattttcgcccctgataatttttgtaagcttacctaagcctcccttcttttgagatccccttcttaaaagggtccattctattaaccctaccccatatccagttacttttactacctgctgatctatcgctaccttgtccaattcatgggaattacagggtgcactgggacaagagtaaaatgatccaacaaacataatgttgcatttaaaaaaataagctaaaagatactgatgactttttataactacaacatattcgtttgtgaataagaacatatatagtaaaaagatgaaaatgtgaacaggttgactatttcctaaatttatggcagaaggttgttctggagaggatgggaagaaaaaatgaaggctggcagtgatgggtggggaaatgcaacctccaaaattatctatctatatatttttattaaaaacacccacagtaattatggcaaatgttaatggtttgtttgttctaaggttttggatacatttaagatctcttgctttctgggtaccatttcttttcttttcttttctttttttttcaaattaattccaaaagacttatatctgctacatgaagaacgaagcaagttcagctctcttggctgaaatgttcaaatgcttgagggcaagg

SEQ ID NO: 179 - DNA, 427 bp, Homo sapiens
ctgtgaatctgtctggttctgaacttattttttagttattggcaatctttgtattactatttcaatctcttcctggtttaatctaggagggttgtatatttccaggaatttatccatctcttgtaagttttctagtttatgcacataaacgtgttcatagtagccttgaataatcttttgtatttctgtgatatcagttgtaatatctcccatttcatttctaattgagcttatttgaaacttctctcttcttggttaatcttgctaatggtctatcagttttatttatcttttcaaagaaccagctttttgtttcatttatcttttgtattgtttttgtttgtctcaatttcatttagttctgctctgatcttcgttatttcttttcttctcctgggtttgggtttagattgttcttggtttctct

SEQ ID NO: 180 - DNA, 728 bp, Homo sapiens
caaacacaaaagtcactgtgtgtgtgatgcttctccaattccactcatcctggctgccattcatgcactagtgcatgtatgcatttttacattttttaaattacaaaaatcaacctattataactgcttagatatatatgaagtaaaaatgaaagttctccctttacatgacccatcccccatcatttccctctttatcttatactgtcagcattcccagcttgtagcacagtgtctggcaatagtaaatcctcaaaaaatgatcaatgaataatttaataatgattaataaataaattaatgatgatggtgaagataaattttagcatttattgaacgctaactacaaaccagggagtgtggtaaatattttataaaaatcaatgaatgagctaaaatgccattctattatttttttggatacggtttaatattttactcataaatatgcttaaagaatattataattatatgacttagaatggtaaaacaatatgtacagcagtatcctattttttagaataaaaatataaatatgtgctcacatatgtggttggggcatgcctagaaacccgattagaacgggattttttcttaccaccattttttttacctgggaaaaatatgggaaaattttatttcccttctttttggttctaaaatttatatacaggagcctatttggctttggataaatcattttaaaaaaggtggtttaaaaaaaaaaa

SEQ ID NO: 181 - DNA, 546 bp, Homo sapiens
acaatcctttggaagacactactgggctttgggtgctgctttttaataattgagttattttgagcttgccaagtaggatctattgcctggactaaaatttatttcctaatcttctgatgaccaagaaaggaaaaattaagtttgcagatgggagatgaaatatagccagcgaatatgcatactggttctgaatgaaaggaattaacttttcagtcaagaaacagtctgcatgccgtaaattgaatttttcctgcaactggaatgattggttaattctttttgaacactggcctttctccccaagaacactaatgaattgctaatattttttaaagaaaactggttttttaattaggtaagctccacttcctcttattttttaatccctaaagaaaactgttaaaagggaatggatctatcacgccttttcttttaaaaccacctttttaaaaaaggatttttccaacccccaatttgctcttattttaaaattttgaacgccaaaagaagggaaataaaaatttttcccttaattttaccccctta

SEQ ID NO: 182 - DNA, 333 bp, Homo sapiens
ggccactctgactgggtctgctaattcacatgctctttgtgacatacggctctaagaggcagaggctggaagagaagtatgtgggttgtgggatcaagatacccaagtttcagtcttgacactgctattacttagtcaggtgaccactgtaacttcatcttgattgagcctcagatgtctcacctgcaaaatggagtttgaaatttgctatggttgggtgtcacacggattaaatgaaataatgcctgttaagcgcctatccagcacttaataagatggccactgcatcataatgctttgggcacaagtaacacaacatccaacccaaagggg

SEQ ID NO: 183 - DNA, 393 bp, Homo sapiens
ctgaatttcttgggctttatgtggcagtgtggtaaaaatatatgatcagatttcactgttaagaaaattctttcagcaatacatgtagagtcaagtttcttgcatggataactgaacatgtgggttatgagattttaaaaaatgtctcgtgacaaactttacggaaatgcaacaatctggacatctagttttgtctgagagtggcgtggatatgaagaactgtgctgttggtgctgatgccacactaagttttggcagtcacactcttggttcttcatatttgaggagatgggatggtgaggaggcctgttggctttattttattacgtgccaccatctagaatacagattcttggatatttcatcttcacaaaggtgaagctgcaaactcag

SEQ ID NO: 184 - DNA, 700 bp, Homo sapiens
  misc_feature 74, 503, 629, 656: n = A,T,C or G
ccaggscawtgaggaaaagrgaaagaatwtarrggstwttcaaataggaaaaraggaagtccaaattggtcccntgttkgccagataaccatgattgkgkatttagaaamccccatgwtytcagcccaaaatctccttaagctgattaagcamcttcagtaaaktctcaggataaaaaatcaatgtgcaaaawtcacaagcrttcctatmcgamcaatamcagmcaaacagagccaawtcatgagtgractcttattcacaattgctagtaagagaagaaaatmcctaggaatacaacttmcaagggatgtgaaggwtctcttcaaagaagaactacaarccrctgctcaaggaaataagagaggmcmcaagtaaatgggaaaagcattctatgctcatggataggaagaatcaatcccgtgaaaatggkgatactgcccaaaataatttatagattcaatgctatccccatcaagctaccattgactttcttcmcggaattnggaaaaatctactttacacttyatagggraccaaaaaagaagcccwtgtagccaagacaatcctaggcaaaaaagaccaamcctggaggcatcacagtmcytgacttcmaactatwctaccaaggnytmcrgkgmccaaaacagcacggkacntggtmccaaaccrgacwtwtwgaccmmcagacacagaacmgagg

SEQ ID NO: 185 - DNA, 192 bp, Homo sapiens
ccagyctttcttttaagtaagcgctttttcaagctcattgtagctacaaagtcaataaattggtctttgttatttttacctgaaaaggctgttaaaggttaaaatgacaaactcaaattcaaagggattggaggatttggtgtttatgatttctcagaacaacaatctagagaccaccagggtgggtttcag

SEQ ID NO: 186 - DNA, 688 bp, Homo sapiens
gtgctggaattcgcccttagcgtggtcgcggccgaggtgggatatttcttctggatagatttcagataggtagttccctcaaataagattatatgggtttgcattttcaaggcagagttgtatacttcctgctctttatttaaataaaaaaacttgaaaatctgttctgcccagtattgtaagcgctcaggtacaaatatgaatgaaacaatctctgcctaagtaacacaagtatagggacaagattctcagtaaaattctcacgtgaaatttgtaactcactagacactatcaggagatcaataattatgtaattaaaaaaaataattacctgccaaactgggttcttctttggcacttctgcttggttttaagacaattctcacatagaagcttattattccccattagtcattccatagatgtaaaactggtagaaacaggacttgaattgaacattctttacaagtaagttatatagcttctgaaaaaagggcttgaaaaagcatttttggggactataagaaccttcaaatgctttcccctcttaacaaaccttaaaattattttgaaaataatttaagggggctgattttctcttgtcaaaatcttgaaccccacttaccaggtggttggtcaaaccaaagttcaaaaaaaagcttctggcctttcctttatcccacttgca

SEQ ID NO: 187 - DNA, 779 bp, Homo sapiens
gcaaaaaacagatacattttcagtgtttaaaaatgaacaagtatggaaaggcttatacagtaactgaaaagtctcctttgggaagccaaggtgggaggattgcttgaggtcaggagttcaagaccagcccaagcaacatggcgagaccccatctctacaaaaaattaaaaaatcagccaggcatggcggacatacttgtagtagtaactacatgggaggctgaggcgggaggatcacttgagtccgagagtttgaggctgcagtgagccgcaacgcgccctgtactccagcctgggcaacagagcaagatgctgctctaaaagaaattttcttttaaagaaaaaagtctccctcatagcctgttctacaaaagtcctatttcttcccacaaaaagcctctggtacctggtgttagttcttggggtggaagattacttttaaaaatagaactattttttaagtatatcttttagggaactttagttcccgaagctttaggaaatgggatcttgaaaacaaaagggatttcaatacctatgacaatgcttaaagaattattggggcatttatttttcaatggagggtccacaaatctttggaaacccttggccaattaccagaagccactttaatttttgaccgaaaatgtttttaaaaattggcttttggaaaaactgtctctttccccaaaaatgaaaaccttgaaaaaaaggggaatttttaaggttgccccctcattaaattttaacccctctgaaagaaaaccctcttgtgacagg

SEQ ID NO: 188 - DNA, 394 bp, Homo sapiens
  misc_feature 307: n = A,T,C or G
ggcgamgtctggycaccatcatgccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggyaccagaagagggctaagatacgttytctgtcttngagctgaaagcacagyctactctccttcgttttgycgatgagaaaagttgaggccagaagggaggtgacatgtttagagtcacccag

SEQ ID NO: 189 - DNA, 681 bp, Homo sapiens
aagttctgactttggtctataaaacagggttattggctgtggctgcactcaatatctaaaaagttattaggaagtgcctcgttattgtcattaaagatatctaaatatggtagaccaaaggttgttgagaaacacatattatggactgagttctgtttcttctgctgtggcgcacctaagctcaagccttccttctctccctccccttctggccggcatggtatctgagctcacagacagacaaggcatgttagaatcatcagatcatgagcaccgtgctgggatttagccctctccaaagtcaattcttacagtccatactttgcttaaatcctcagttgttgaggtctgctctgctgtcagtaatcccagctataaatttcccccaaatgtggggcctagataaagtagaaggtggatggactcagcttattttcatgggatgacaggaactggaaagagaaagggcattgaaaataaaaagttattccagaatagcattaaccctcttactgttcaagaattaagaaagcctacttagaaatgagggccttgagaatgatacccaaatattggtctttctaccaaaaaatggcctttccaaatatctgctttcctgttccccaattggctttttaagtagaattaagttacctaaaactttacctgaagggtggtttt

SEQ ID NO: 190 - DNA, 839 bp, Homo sapiens
caaatacatgatttccattggcatagactcttctatagtctctcaggcacaccttatgactaataagaacactgtcttctagatataagccaagttttaggagttatctttgtagtttctgtgttgagactatgggtcttccctgtgcaaagacttgattagcaaatactatttgaaacgatcccaaattcatagtgcagttgaccacccttctgatcaaggggatctctgtatatcccatgaaagcttcataggtctcaccctagattaagtgcttcacttctcaagacagtgaacagatggaagacttttgtagttatcattatacaactgtgccctgtgtgttttattatacaaccagagaactgaggcactggctttacctgtcagctacgccaggggtgtgacgtcatctttctgacttgatcacacatgccacattgcttaatatttcaagcttagactgaaataatcctgtggtaaaaaatttttggggggctggggaggtaaagaacaagggggggaactttggaatatttttattcattaatcatatttcccgaattgtattttattttgaaatgaccataagggacttaaatacgtattgtggttaaattaaatggacccaaatggaggtaagtaaacctaatgggacaaatgaataaaaggtttatgactgggagcatttacccatgaacctccttagaagctatttaacctttcttttggaaagccctgaaggctgggaacttaaattttaaagacagtacctatttccagaatcgcttccaaatggccatgttttaaagggccaacattttgggatggccctgccc

SEQ ID NO: 191 - DNA, 697 bp, Homo sapiens
ccatcctgaatactgattttctaatggaactctattcaatggcgattgtaaaaccctgaggctccgttactattatggagcatactttcatctcattctcggctattgggcaatatgtatctcataagattttatcacatttcacagatgaactgttaattgattccatgggtacgattaggcgagatccaagctggagctgcagctctgagtcccataaattctttgtgcttctgtaaagaataaatctgtttttaatgcaaattaaaactactggcagggaattttggctcccagttattaaaagactggaaatgtgtaagtggagaaaggcaataactgcagtaatctcttaccggactctattataattccaaacatacataatggtgagaaaaaccgggaagggaagaatgtggcaatgtccactctttgccccaaacataacccttaatttccatggcgggcccaaacactggtaaaaaccaaaatggtaccctctatagcatgcaacttttatttcactccaaacgaaaaattattttgactatggcttgggaaatccattagtagaagaagttttataacctataggaacccggccatttcatttctaccaaatcacaggaattttagaatgggcaaggaatttacaggaagacttgcccaattatctttttttgggggactaaaccaa

SEQ ID NO: 192 - DNA, 687 bp, Homo sapiens
ctggttactatagctttgtagtataatttaaagtcaggtaatgtgattcttccagttttgttatttctgcttaggatagctttggctattctggatcgtttgtggttccatataaattttaggatagttttttgctatttctgtgaagagtgtcattggtactttgatagggattgcattgaatctgaagattgctttgggtagtatgaacattttaacaatattgattcttccgattaatgaacatggaatgtttttcctttatttggcgctctctttaatttccttcatcagtggtttataggtttcattatagagatctttccttcttttgggtaattcctacgtatttaatttatgtatcgctattgctaaatggaatgactttttaaatttctttttcacattgctcctggtggcatattaaaagctactgatggatggtgattttggattctgccactttactggaattggtggatcagttctaatcgttttcttatgcacccctttacggtttctacatgtaagaatatatcaccttcaaacacggataatttgacttcttccccatccaattgggaggccctttatatcttctcttggcctgaaggctctacttaaaacttcttatccctttgttggaataacagtggggacaaatggacatcccttgtcatggtccca

SEQ ID NO: 193 - DNA, 493 bp, Homo sapiens
ctgctaaaatgatgttgctaaagcattcctttttcttttgattaaacttcatgtttacaaaaaaattaattctagcagaataacgaatggttttgttttctagttctctgctgaatgaacagttttgccaattatcttcatagagtagtgatataatgaatgcaacctcaaatgcaaaccaaccaattcacagtccataccccaatcacttccttcatcagcctcaaaaatcgctaagtgaaccagtagaatggttttggagcagtaataggaaagcaaatagaaagtcaagggggactttcaacgccaacaagaccaattcagatcctgatctgactggtttctaatacaatctctttccagagtaatggagcatgagtctgccacacagaactttagagagagtcctttatttcaaagactgtaaagttggaagaattcattcatctgcaaagtcaaatgtcaaaagttgtgcttcccactcctcatcagg

SEQ ID NO: 194 - DNA, 424 bp, Homo sapiens
  misc_feature 9, 12, 17, 30, 179, 187, 265: n = A,T,C or G
cyagggcanttnagcangasaaggaaatanmggggattcaattagggaacwraggakarwcaagttgtccstgtmtgcagatgmsgtgattgtatatctagamcaccccattgtctcagcccaaaatctccytaagttgataagcawcttcagcarmgtctcasgatscracmtcwatnsgcraaantcacmwgcattcttatacaccaatawcagacaaacagagagccaaatcatgagtgaactcccattcacaattgctacnmaagagaataaaatacctaggaatccaacatacaagggatgtgaaggacctcttcaaggagaactacmaaccactgctcaaggaaataaaagaggatmcaamcaaatggaagaacattccatgctcatgggtaggaagaatcaatatccgkgaaaatgg

SEQ ID NO: 195 - DNA, 229 bp, Homo sapiens
  misc_feature 12, 29, 35, 36, 38, 42: n = A,T,C or G
tgaacacccttnggaaggaacctgctcgnatgtannanaaanggaccggacagtctgctaaaatcgccctctttagacgcggcgcgccggggcagagtttttctctggtgctttgacctgtatttggtttaatggttttgtcctaatctcttcaatcaataaaattgtgcgtatttaactaaaaaaaaaaaaaaaaaaaaaaaaaaaaaaaaaaaaaaaaaaaaaaaaa

SEQ ID NO: 196 - DNA, 557 bp, Homo sapiens
gcggtggctcatgcctgtaatcccaccactttgggaggctgaggtgggcagatcacttcaagttgagagtttgagaccagcctgggcaacataacaaagtgagatcttatctctacaaaaaaattaaacaaacaaaaaaacaaatcaacattcatttgcagggctctttggtcttcttaaagaacaaacatatgaaataaataagctgattcttaaagataacaaatataatgagctttctcaactgtaaaagcatctctaagttgttctatcaatgcatatccactccatgaactaacctgaagaaagtgttgaccattctacccaattaactgtaaactaagattgctttaatggtttgcctaaatttgagtacctttaaatttttgctttttatccaaattcattctcccttcttcaaattaaatagttttgttagaaatcggataagcaagatgtactttttagaaagggcaatagaatcctacaacatgctagaatttgaaatgtttttttaaatcagtmmtttctctatgctagtaactaagaaaattata

SEQ ID NO: 197 - DNA, 624 bp, Homo sapiens
ttttactacctatatttaaaatgatccctgacgcccctcaagacaaatatattaatttttttactttgtgggatagagatcagaaaaagagtagagatgaaaatactggagaaacaatgcaggagatatttatgaggtgagaatgtcaagaaacttgtaaagggagaatactataatgacccctgaagagagagctttagaccagttgagtattagaggttgccacgtggctattcatccactaataaatacaagaaattactaaaatggaagccactggaaatatgttttgaggaaggtgagaatgtggacctattataaatgggtgaatatgatttctttctcattaagttcataaataactttcagacatgtaacagtttatgaagtgtgccgtagtcatttagtataagttttatacacaaaagtgtttttactaagactgtcacaggttcttttgtgaatcttgtttgtttttcctcattgtaaatactgcaatagaacatttgtgtcttaacataaggcaataaatgaccttaagaaccttcacttttatatagaaagtggaggaaaagttggcagagtaatttgttgattatagataaaagctcttgtagaaattgg

SEQ ID NO: 198 - DNA, 175 bp, Homo sapiens
ttttttttttttttttttttctaacacttatgcatttattttcatgtgtaagaagaaaaacgtaactagcacgtgaacatgactgcatggatacacggctcagcacgaggctaaagtcagaagtgagtgaaagcaaaaccgcatgttgatttaagtgaaataacagaacagaaaa

SEQ ID NO: 199 - DNA, 871 bp, Homo sapiens
ctgttgatcaatgatgagctcccaagagtaaccagcctctatatagtcagcatcactggtttctcaggaaaagcatcaccattgttcatcttgctgcaaaatgtatgcacaagtatctttttatttttaaaaaagccctgacattttatgactgctgcttttctaagatattttcaaatatacagtccatacggttcagacacaatggactggggatagagacggctatagtgccgataatggagaaactagccagagcttcagatatttgttttccaggacatctcaataattgggtacacctcacaatatgtgagacttgacgtcgagtggcacggcatactctggcgcaggcacttgataaagactgtgtttgcaaatacttagcctgcacttcaagataccaggcatctaagcacgtcccagatggtgacagttaatcttcaaaaaaccctatgtggaagtattatcattgtcctcattttacagatgaggaaaaagagacacagggatgtcaatatcttcctcaaggtcacacagcaagtaagtgatggaacagtggctcagccatgaagctattgctgttaaccactaggttgatttgccttcattaatttcttcctaaaactgcacatttcccgttagtccctctttttggtctgtcgtttgactcttggctactgcttagaggaagattcattctattattttctaacttagtaaatatgtgcaactccttggggacatgaccaggcaaaagctggatacagaaatgtatgcccaaacaccatcccaagttacccctaacaggtcttttctggaccctgtttgtaaggggggtatatttggaaaaatttttaaaattttctgg

SEQ ID NO: 200 - DNA, 737 bp, Homo sapiens
gacattttgaaggtaacagcaatatctgtgtatagatggggttgtggttttgttatttatctgctattgctgaactatcctttgtcttgagcgataaaagagaagtaaaatactaaagaactgaactgtccatttctggaccatgagtaaagatgctggctgtcaaacttcctgttcatacattagtttatttatagagtgtactctctatgtaaggtattgactgataatgttactttgacttcagatagcttgcagtttaatggaggaagaagacaaacatgcaaataactaggtcaatgaggcatcctttgtgttccattggaagctaggctgctttgtaaccttgttaatttctgtggttttggagtgcattcattagcaaatacaccccttgttcttatccattctctgcttttttctttatttggcatttgatgacattttttcatgtggggaaattgagtcaggtgaggtggaaagaaaataaggacacgacactaaattctttgatgtttttccttaaaaaattgtttttcaagtgctccataaagggttgtgaagttttaagagccataggacttggattattgtgaaagagtgtctctagggggccaggttaaaccatttcaaggactctccttctctcatctcccttgttccacccagggtggcgacccccaaaaagcacaaagcctccctttcttcatgggaagggtaaggaacggaagggaacc

SEQ ID NO: 201 - DNA, 493 bp, Homo sapiens
tctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataacacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacatgaacattattttgctttaaaaactataaacattgtaggagaattatagccagtcttcagttataaccactccaccctcctcactttctctctctctctctcttttttttttgctatgggatttaatgggaaaaatatgtaaaaactgtcactaa

SEQ ID NO: 202 - DNA, 283 bp, Homo sapiens
cctttttatctcagtgacaccgtccggggacgcaggtggtggtgactcaaggctagcctcaaagggcagccccacctcctcatcctggaccacagagaccacctgcttggcgcgccgtcgcttttccgagagggtggctgactccggggtgctggggctggggctgccgcccccgccgctgttgctgtactcctcgccccagtcgatgggggctgccctcggacagcaggtgcaggttgggggcactgttacgcaagaccatgctgcccggagaggtagatct

SEQ ID NO: 203 - DNA, 713 bp, Homo sapiens
ctgcttttgcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaacccgcaggagcggcaccgcaggtggatccagatcttcggacgccgtgtaccacatggtgtacgagcaggccaaaggcgcgccttcgaaggagggggctgtccaa

SEQ ID NO: 204 - DNA, 275 bp, Homo sapiens
gtagacaagtacagcagatccagacaccagatctagctaggctaaatgtacagtatctaacttgatctgaactgaacctgtattccttgatgatgcctaaaactacatccatagaattctggtgaacctgtaatacagttctgaaagtacagttttatataataagatgctgatctctttattctttcaagtaagagtgctagagaacaaattgtgttacttgccttgggatttattgaacgtctggaaaatgctgtcttcctagatccaaacag

SEQ ID NO: 205 - DNA, 694 bp, Homo sapiens
ctgttcctgtacatttaactgaaaaaaaagtaacttaaaataatataaaaatagcactcatgtatgtcctacagttataggtgaaatttgatattgtttgtcttacatagcatacctatagacagcttaagtaaagtgactgttaagagggttatgcttattgatgaactcttgtagttgcttaccagctctgttagtatagttaaattgatctcagtagcttcaagtatttataaaatggttgaagtccaaatacatgtgataattacaatacactttgaattaatggagggtgggaggctagttgaaatgcattttatttacccaaggagtatgttaaaatgatagttataaatgttggaagtttaaagcaagatactcagtttagttctttacaaatcataagaagaacaaaattagatgttgacattgctattttaggctgtgtgttttccatatgcttcttgctttccctgtcacaggtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtaccgtacacaggtgctgggtcgatggccactttctgcttttctttc

SEQ ID NO: 206 - DNA, 704 bp, Homo sapiens
  misc_feature 12: n = A,T,C or G
tttttttttggnaaaaacagggtttcatcatgtttgccaggctagtctcaaactgctgacctcaggggatttgcccgcctcacccaattcaactttcgtaagtcagtatttaccatctaactcagtgtcccaaaatttaaaatttccttgcactttacagcaaaaatacatattggggctctactgaagcaatatatacatgtcaaaactaaaaatcagaaaagcaaaagggtccattcaacatatagcagcttatatttaaatatgtacaggtatgtatgttttcacagttagatctttaaaaaaatttatatttgatatgttcaaaaatacttctattggctataaataatattttaaaagctcaactgatcaaaatgcattccaagaacatatcaaattaaataaatcttctacgtctttaaaaacagataattgaagtcagtaaagcttgaggtttgtgttaagtgtattctgtcagtccctactactagggaaggcagaatcttctaaatacgatacgaaagaaactcccaaagcttggaaggaatcggcagctcctgaactttttggggggggcatccctcttcgggattgacatgcgacataaatgttgcaagctaagggaccccccccgggggagtgggccccaaaaaaaaccacaccttccccgtcaatggtggtccccccaccaaccttaaaaa

SEQ ID NO: 207 - DNA, 225 bp, Homo sapiens
ccattttaactgtactgccaatagaattctggaattgtggaaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggca

SEQ ID NO: 208 - DNA, 678 bp, Homo sapiens
  misc_feature 382, 391: n = A,T,C or G
cctatatctatcaaaaaaaatccagttcctaactaataatctcccaaaaagaaagcaccaggaccagatgatataaatggcaaattttttcaatcatttaaggacaaaataataccaattctgtatcatttcttccagaacacttcctaactcatcgtatgaggccagcatcactctaatagcaaaaccagataaagccattacaagagagagtgacagaccaatgtggttttattgaggatgcaaacaaaatttaacataatatttaatagtgaaaaactggatgctctttccctaagttagagattaaggaaagaatgtccccttcactactcccatacaacaccttactgaaaattctagctagctttataaaataaanaaaaaccanaaaataaaataaaaggtgtacagactggaagatacagtgaaggaggaagaaataaaattttctttgcgcataacatgattcttctatgtggaaatcacagagatttgaacattttttttttttgagacagtttttgctcttgttgcccaggttggagtgtaatggcgcgatctcggctcactgcaaccttcacctcccgaattcaaggtgattctcctgccctcagccttcccggagtaagcttggggattaacagggcatggcaccccccatgcccccagctaaat

SEQ ID NO: 209 - DNA, 720 bp, Homo sapiens
  misc_feature 366, 399, 406: n = A,T,C or G
attattttgaaccctagcatttagaaatgaaaaactttttataacaatcaaatacatgataaagtatgcaaagagtaggaaattattctgatgacatatggagggttacaaaggagaaaactttttgctacctctgataaagaatagactaaattctccaagaccaatctgactggtgtcataataaaaggaggtacacacggaagcacaagggatgtgtgcctctggaggaaaggtcaggtgaggactcagtgagaagacaagccaaggagccaggtcttggaagaagtcaaccctgttgacaccttgatcttggactaaccctgtggacaccttgatcttggacttttagcttccagaactgcnagaaaataaatttttcttgtttaagccacccanagtgtantgttttgttatggcagccctaacaaattaaaattatattttaacagagaatataaaattctaatataacattttacagtaaagcattcatggtcttttttttcttattaataaatccatcaaaacagaaagttttgcaaaattttaacacatttctctaccactactgtttctactctcttaaaactactccgcaaatataaaaatagaaggccaaaatgcatcattaaaacgatgtttggggactaatggccttaaaattctattacacttggaaatatacaaatattcaaagattatctattgatcacctca

SEQ ID NO: 210 - DNA, 277 bp, Homo sapiens
tccatgtatttttatacagaatggaacaatatgtatgtatgcaatykttacattccaccatgaaataaaacagtataatgaaaataacaatagattcaaacaatgatatgctatttttttttacctatgacattggcaaggtcttcttaaaaaatctgcgaataaccgatgttggagagatcatggggaaatagccactcaaatgttactcatgagagtgtacatatgtgtaacttcacttggagggcaatttggtgatacatttaaaaagttttgg

SEQ ID NO: 211 - DNA, 715 bp, Homo sapiens
gtggtagaaatactaattttgcaattacagaaaaaaacaaatgccattcacatggttyctaacaaaaagtgtctgaccacccccaccccccacccctcaaaaagcccttaaataaagaggaagatcaaaagaaaacaaaataattcccgagtttcacctcatacatacaatatagcacaggaagtggcaaagtttaaaataatgcctttactgttaggactagtatgctgtcaaaagccacaatccttttgttttagtgagttgattttcaatagaaaaatacaaatgaacatgtgtttaagttccaacatggattgagcacctctgaatttagtatcaaatgattaattttatttttcagatgtcaaatcttagtataaaattttccattattttaaacttcacttgaatctttaaaaaagctgtctaaattgtactatatgagttcagtttaatcttctgtaaaatgctaacaaattgaactgtcagcagtcttttaaaaaaaaatgggggctgggttatttctagaagaactctcattaagctttgaaaatcagaaatcagagacaaataacttcagatatagactagctccacaagcaaatttatacaattatctgtaacagtctatacatatatgtgtatatatatataccgtaaccactttcataggtaaaaaatattaacttcatgtcacactatgatcagaagtata

SEQ ID NO: 212 - DNA, 717 bp, Homo sapiens
agcctcccccaatgccttaaaaggtcacagtagatctcagctctgaacagaaactcaactgaaactcttcccacaacccagcagtagatatattaaaacctacaattttcagggatacaaccaatatttaattcttttgagggttttgtgtttaatacaaggacacaaacacacgtataaaatgacgatgtcaatactgattaaacagaacaacaaaataagaagctcaaattatcatcagctattgtgtatatctgaaataacaataatgcacttgattctgaaagaatgattagagttcctactctgaaaatctaattgtcttgatgtggcgaagtgagaagaaaggatgatttttctaatgaaaagcatgtatacgggtagccctttgcgagattctgtcaaaaccctgaattttgcattagctgttttaccacccaaacgtttttacccgaggatgtgcagcaatgggaactctcatacactgcttgtgggaatataaatcagtataaccactttggaaaaccatttaacattgtcaactacagctctacacacaagtgctataaccacccattccactccagggtatacaccctaaaaatatgaagtgcccatgtctacccaaaaggccgcctaaaaggaatgcttttgagaagggttaaccttgttaattagtggcaaaactgggaaaacaacccccaaatggtcccatcc

SEQ ID NO: 213 - DNA, 599 bp, Homo sapiens
cctgttttggcgaggcaggagggaagcgggatgggagtggtggttaggccaagggtagttcaaagcgattcagcaggatgatgaccacaggagtgctggagccgggcctttcagcccccgtgtggatgatgaccggccatccaggacatgcgagggcttgggacagtggacagccagtgccacacaaggaaggaccgattaaatgacacagttaaaggaatttggcctagggagtgcaagccagaaaggtttggtctttttatatatgtaacattggaaaaaaggaacatctcctgttccctgtattaagttttgactttagctcagcaaatgcagtgtttgtggcagtaaatatactctgataacaatgttctttcccaggaatttagagttttatgatggttattgaaaatgtttacatgacaggctgtcaataatattttttgcctctaaaaataaaacatacataaagtgtacggattttaagtatgcaactcactgaacttttcataccgtaatacaccaccctagtaaccctcccccagttcaagatgtagactgtttccaataacccctcatcctgttccttaatagccccc

SEQ ID NO: 214 - DNA, 789 bp, Homo sapiens
ccttatgacaaaccttgctatgccaaggatatgcttcactatcttcatctatcaaaacactatgcatcatagatatctaattttttcatctcttgcatgaagtctttcctgatttccctctgctgaaatttctctcttcaaatgatgtgtttccatagtactttgtcccttttcaaagatatatctcacatcgcatattttaccacagttagtttcatttcttaactctcacactagattacaaagtcaatatagacaaagaaatgttcaaccttatataacctcctctgcctatgctggtaaattgcacctactatgtgttcaataagagcttgtctttttcaatatacaaaactttgtaaagattaaagaccttgtagaaagtcaagaggaagatagcaatttcacttctaagaacttaccctaaggaaacattcatgaagagatacaaggggttatgtgcatggatgttcattatcatattattcttcattatgaagattatgatggtaataatgaaaatgattatcttgtattgggccttatttgaagtcaagcattgagaatgtactttatctgcattatctcactgagttctcgtagcagccctataaggtacagactgttatctaagcttaaaaaaataaagttaatgtccaaggtcaaacaactagtaaaagaagggggctaggaaatttggaaccccaaaaggggcaacctctcaagggctatgaatccttaccattattataaggaagcttggcccatggtggcccaaaaaaaaccggg

SEQ ID NO: 215 - DNA, 765 bp, Homo sapiens
ggatgtctgagcaggagagagaccatgtgaaggatggactgaatggagacttgtatcaaagagtctgagtatcaaagacttgtattagagagggttgttgtagtaatctagtcagggtatgagaaatggtttgtattagagtgtcaggagtagtcgtggcaaaaatatatagatcaggatgagggatgggcctcatctcacaccctgactccagtcaatggcagtggctccctggagtacactactataggaaggattttgtaaagttttgtctggcctcagtggagggtgaggtaggggaggagttctatgaacagttagtggtgtctgccatggttgaaacaatggagaagggggacaccttttctgtgcagatgttgcttctggtagatataatccacaatgtaatgggagaagtactaagaatcagtaaattatggagggtgtaaaagactactgatatttaagcctgcggaccggacttagagaaatgatagttaaaggagaaatatccagcaaacaaagatatgacattgaagtttgggactgcgattagtaccagagatttggattggaggtgatttgtatagaatggataggtgattttactcttgcaatttggattgaggggtggggaaaaccagaaaggggctggggggtaaattagtagaaggtcaccttgaattcattgtggtccatatcaatgctgaaactgattggggaactttttactcttgagtccctttgtaagggaaccccagaaag

SEQ ID NO: 216 - DNA, 780 bp, Homo sapiens
cctttttctgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtactttttttttaattttgatatacattgtgtgaaaaaagaaaatggctaataaactgtattaaatcttaaacaatgtataaagattgcacttagccagttcaaagtgtatacttattcataatgaattataacagttatatttctgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaaa

SEQ ID NO: 217 - DNA, 810 bp, Homo sapiens
cttttaggcagcccggcaccttcatccataggcagagagagaactgggtgttggagacttattcgagggtataggaagggccctgtgaagttgatttaacttttggatgtcagactgtgaaagctcctgagaaacttggggtaataggatcttcttttggggatgaaaatggggaaggcgtgaggacctagactacttctccctaggtcagaaaaagagaattaccccttgacaaatatgatacctgctaggtatttcccagggaaatttagggattggcgtctttccctagcatgtggaggaattggcagacagcttcctaagggcggggagcgggggcccaaggctgacactgcttgcatccacgtgaccttaagttatggcagatgactctgaaacggactgaggccaatgagaacagatggatggagcactcaggttagacttgttccttctcctatgctggaggagagggatggttctctagaatgttggaggtgagttgagagctcgcctcttgaatgttgaacagtgtactcttctgaaaactgcatattcactttatgtggtttcagaatactgggctcaatactaacataagaaagacacttcattgagaaattcttaagcttacagaaaacctatctctttgcacattccacataacccctagcaaaatgcaggttcttcatacttctgtcctttttccattggaagaattgcttaaggaaaaattaattcctatttattcccacaaaaggttgggcattgctttgattttaccccatgggggaatgtgcctttgaattt

SEQ ID NO: 218 - DNA, 817 bp, Homo sapiens
ctgctcccttatggaggtctcttcattaataattattggatagatagagaaggtgagcctgtggcttccaagtaccggcttttgctgaaggtctacatgggaagaagagcatcatttgatattcagtagatctgccacacccaactggctccatctcctggaaaacagcactcactacaagcaactgtaatagcacccagcaatgaccacgctgctcctgctggctcttccgtacaccagtaaatgaactcaccaatgtattgcacacatacatttcacagtagtacaataaagccctgtatcaggagtggtaattcaatgacttgactctatagtgcactgcagctttatgtcataccaacattcaaatattcaaatatccttccaatccatttggacaaaaatacaccatggctgccaagacacatgtatttttctttcttccatggactcctaaactgctcccacaatcagcagtgttcttctctcagaaattatcttaagcttctctactcaatgggaggtacacacagagacctgagaatatgcagaggccagaatctctgtctgtgctagagatcaactgtactctgcccacctggggaacacatcctctgggtaaagtactcggaagtaaattacattccctggagacagatacgggctttcactgcagcctgttagaaaacacaatgtctgtaagttacctcataggtcaaagagttttggattatatttttcataatggggctatggcctttttaccctggttttaatacagaaccacctgcagaaaggacattgaaattaaaagcca

SEQ ID NO: 219 - DNA, 661 bp, Homo sapiens
ggatgctgaggcaggaggattgagtcctggagtttcaggatacagtgagctatgatcatgccattgcactccagcctgggcaacagagcaagattctgtctctaagaaaaggaaaaagaaaatgaatagatagtggtattagatgttaatgacatcagttgtttttattctttattctttcttagaaacagattagttttctcgaattaaagaactaccatttttcttttttctacaactttcaagagctggtgaagaaatgatgtttagatttaatagatatagtagcagtcatatattaatagaatagaaactgagactctaggaaaaagatagacatgagataaggagtaggcatggtagacatttctagattatttatgaaaatgttgtagaattcatttttttttttggtctgacctttggcaatggtgctgaggaagggaaagccagcccatcaggcaaggctctgttttctgcattttatcccgtttgattcttctcgttaggattggagcaaataatttcaatatgttcttcgctgggtttatcatagtgacccttcatttaaagggacttttaacaattgacttaaagaacactgagatgtgatattttattgggatttgaaagttgccattgggttttaccttccttaatt

SEQ ID NO: 220 - DNA, 792 bp, Homo sapiens
  misc_feature 169, 171, 172, 399, 400, 401, 402, 643, 666, 724, 727, 731,755: n = A,T,C or G
cctctttttattcctacaaataattttcaagtacacacaattgggtaaacaaagaaacaaagccaccaagaatgaaaatcagtaggaataacgaacaagactcacagatgtcaaacaagtctgtgggtcttgcagacttcagatgttggaattattagtcgtggcaagngnncaaaacattagctattaccattatgtttaccaactagtgaagtgaactatgagaggatatattaaccacagaagttaatagaagaatagactcctgaaaatatctggatgctacaaactaaaatatagtatataatccttcatagagtgtcagtgacttcatatttataattacatttttgtatattagcagtgttctagttcttactgccttatctttaagctgannnnaaataaaattatattttgggattcaaaaacacatagctaatgattactatgtggcagtgttacattactttatcacatatcattaacataatctgcatgtgttcaaagagatcttcatacttctttgtagctcccacttctttgtcgtctttgtagctcccacaacatctagaacagcacaaccgtatatggagaaaactcagtctagtattcgttgaatgactaatggaaaatttagttnataaacagaactttcttcattgnacaaattatcttgcagaagaataatggccttagtttaaaattatcatatttacccatntcnccangttattttatctcttttggctaanaattttgaaaacggtaccttttaccctttggcatttt

SEQ ID NO: 221 - DNA, 759 bp, Homo sapiens
  misc_feature 245: n = A,T,C or G
cttttctgctgctccgggaggtggagtggcctggcagagggcacatggctgccacctgctgcaaggaaaattctcagtgaagactcctcagtatgaaggagataagcctgcacaatcagtcactgatagatgcttagtggaaaaacttccaattcccatttacagctctcagagctaggattaaaaactcctggtcataaactcatgtgatgagaagttatagcacgccctcattttctacatanccacttgcatttatggttggcttttgaacttgctagaagggaaagaagtgcaaatgtgtcctccttagagctactctcctccccttggtgggtttccagtttgtgcattgtccagatggcccaggagctgacgatcaaagggaagaagtcatgtttgtcatgagaatgctttgctgcatcaggattcagtgaagctgttcaccgcctggagcccatgcagcctcaagaggcaggatggagctcagaaaccatcactgaggttagaaagtgagcaccaaagttgagggaagcccacaggagtgagccgaagtgctccctttggatttccaaagtgggtgctgctgcttcttccatcagccttgcttctgaccccaatgcgttcctggtgccttcttcttggcattttgctgtcgggggcccaaggaaaaaaattcctgcatggcagtggtgaaaaaagatggctgcctgctgaaacctgatttggcctgggtaagccttttggagccccggttaa

SEQ ID NO: 222 - DNA, 699 bp, Homo sapiens
  misc_feature 5, 7, 77, 81, 84, 85, 278, 289, 291, 298, 301, 368, 395,433, 441, 508, 569, 633, 646, 667: n = A,T,C or G
ccttntnaagagttggcattaattcttcactaaatgtaggagtagaatttatcaggtaagccacactgacctctggncttnttnncgcccgatgatttttaattagttgaatccctttacttgttatatatgtattcatatattctgttccttcttggatttacttttatgattggtgcctattgaggtatttatttctagtttgtggtacttcatgtgtttaggttttctagacagtggacatagaagattcaagaagctaaatgtaggagaatgtntaatgtagganantgaggcnacnatatcatcaatgaatgacttgaagtttcctctgttgtaaagaatgatattaccataactgccatagntaatattgatggtgtaagtcaaataanaaggcaggaggaaagggacatccatcactgaaccacanatcagagnctcattgaagcctttgagaagaatccacaaaattttacaggataattcatttcctgcgatcaccacnagaagagaaactggttaaacagacaggtattccagagtccaaaaatttacatttggtttcngaaccaaagacctcagctcccaggccacagcaaaagggggcttatgaattccctggcacccagncccaagacccaanaacctcatcttgattggtttngggcttgggaaaccaaaaaaccaatgggtggc

SEQ ID NO: 223 - DNA, 598 bp, Homo sapiens
aaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcaatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcg

SEQ ID NO: 224 - DNA, 501 bp, Homo sapiens
  misc_feature 479: n = A,T,C or G
aaacctttatgatgacttccttatgaattactgaacgaacactggaatgggactcaggtatcctgaggacatctctcaactctggccttagttccccctctgtaaaattagggtgccaactaaatgatctacaaggtcccttccagcgccgccattctgtaattacatcatgtgtaactgtattaaacatacacaagtgactgccaggcatgggaatgtaacttccgagtaaatgctttggtttgttcagaatacactatgaacttctttccaaagacgggttgtggtaaatagtggatattttgattataagaaatagagtttccttgaagctttagctggagatacagcaatagtgtggtgttcctacaaatatcacagtgtattcaaacatatttttctatcaaaaatcatttttgtaaaagctgtgtgtttttatccaacttgtgataataaatgttctttattttagaacaaanaaaaaaaaaaaaaaaaaaaaaa

SEQ ID NO: 225 - DNA, 295 bp, Homo sapiens
cctgtatagggctcgtttccccacacatgcctatttctgaagaggcttctgtcttatttgaaggccagcccacacccagctactttaacaccaggtttatggaaaatgtcaggaaaaaaaaaaaaaaaaacacatgcactcacacaatacccaaacatcaraattagaagggcataaaacagggggctttataggctgaaaaatatcttaratttcaraacagaataccaatcaaatattgaaaattcctttgttcaaaacacaaagatgttttgtttttaatgggagttttttt

SEQ ID NO: 226 - DNA, 372 bp, Homo sapiens
agattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccgtatgaaatgaaat

SEQ ID NO: 227 - DNA, 599 bp, Homo sapiens
ggcccccgtcgcgggagccgcttcgggccttctgggcatgtctgccatatggctccaggtttgtttttctccccggcactctgacggggagggctcccggcatctcctggcatccgggtagaggacgcggaggatgctgagctgctggcgcactgcagcacaactagagatgtacggatgcccccatcttgatcttacagaatcagaggtacagccgcgagaaagagtcaagaacagacagagtcgcttgaggactcaggagggtgtttgctgcgttgacaacagactacaccctcacagtttgctctgctcttccaacaccagtggaagatgatcacatcccagggatcagtgtcgtttagggatgtgactgtgggcttcactcaagaggagtggcagcatctggaccctgctcagaggaccctgtacagggatgtgatgctggagaactacagccaccttgtctcagtagggtattgcattcctaaaccagaagtgattctcaagttggagaaaggcgaggagccatggatattagaggaaaaatttccaagccagagtcatctggaattaattaataccagtagaaactattcaat

SEQ ID NO: 228 - DNA, 343 bp, Homo sapiens
aaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaaccgctcaagtacacaattgtatgttctttgtatcccttaccacaaatatctcgctctgctcatttcttttgcagcttcctataaagtttgtcttcctcaaaaaaaaaaaaaaaaa

SEQ ID NO: 229 - DNA, 417 bp, Homo sapiens
ctcaagctgcagtccaccgggtatggttctggatggttcccccaagggagcaggtatgtaggaggtgaagaaaactgagatttcaagtatgggagagtttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcagagtcccagggcagaataatcatccatctacaggtctctgtttcctctccctccgcagcagtggagagcatcccagtgtttggggcactgtgttcctcttcgtccctgcaccagaccctggaagccttgg

SEQ ID NO: 230 - DNA, 462 bp, Homo sapiens
gaaataccagaagagaaagtttcattgtgcaaatctaacttcatggcctcgctggctgtattccttatatgatgctgagaccttaatggacagaatcaagaaacagctacgtgaatgggacgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacag

SEQ ID NO: 231 - DNA, 328 bp, Homo sapiens
ctgtgggttttcctaaacgcccctcatctggttgaagccctagtgtttctttctcacatcagaggcaaatgcattggggtgggtctggtttggacaataaatttcctctggtttggaccaagaaaaacagagttctttgaccgctaacatatatgtaaaaagaaagtttgtaaaaacaagagttaaaatgcttctaacagtgtggtcatcactgcacaggacactggaattggcattcggggttgtgtctgtccatgtggtttcgttgtatgtcatgtgctctcagctcagacagagacatccaattgacttctgacttggggcattt

SEQ ID NO: 232 - DNA, 595 bp, Homo sapiens
cgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttcc

SEQ ID NO: 233 - DNA, 600 bp, Homo sapiens
atgaaggtaaactctaaaatcttcataggtcaacaaagaaaatttatccttcacacttatttctagaaagcagcagggcttatttcctagattgcttacaatgaagctagaatatctgcgataactgtagagtttcaaaaaggatccctagggctacttctacgttctccttaccagttgagcactctccataatttccagacgggtcatgggggagaatgatagaaatgagcgtgggaagaaagacaatgaaattagaaatgggtgagacacatggtggtagaatgctaagagcagggatcaggacaatcaaccaggtgtctaggaagggtcaagtcaccagtgtcatctgctgaccaatgttaggaagaaataaactcaaaggaaacaccacatttttccaattaaactcaaatctattgacttgtggtggttctttgatgttgtggggactgctataacagaaaccaattggattttcaagggcaagaaactttgccactgaataagatgatgtcatccttcctgataacaaataggaatgggtggtcagctctaaacagcgtggactgagggagttgcttttctacaatattactt

SEQ ID NO: 234 - DNA, 500 bp, Homo sapiens
aaattcctaattcttttactatcttctcaacttttcccaaagataaaataaatttcacataatttcatggaggggaaatggtagttgtaaaaaactacctcaagtagcaatcaccgctggcagtgttttctcactttctgttctgcaattgcaatcacacttccaaaaagaaaagcaaatgtttgctaaaccatagacagacaacctctttgtgactggtattataaggtttataatgaaaacttatcaaatataaaaggtgctccctcttgaaaatgtgtattttatttgaagttttgagtaagaggtgagtgtttggcaattttcaacactcccctcaaaaatctcccaaagttgcaaaaaagtcagtttagtaaaattccaagcacttaaatgcttcattgagggccagttgatatacgcaatgcactaatgtgtaaaaattaaccgaatgcaactattttataatggagagctcttaccttttccttccagttttt

SEQ ID NO: 235 - DNA, 159 bp, Homo sapiens
aaaatttacagataaaggcagttcaatactgccactgagaagtacatctcttaacatatacaactttcaggccacagttttgaaggtctgaagtattaagttggtttgatgaattagtcggttggcacttacgaacacatttattgccttgccatcttt

SEQ ID NO: 236 - DNA, 254 bp, Homo sapiens
aaataagtgaataagcgatatttattatctgcaaggtttttttgtgtgtgtttttgtttttattttcaatatgcaagttaggcttaatttttttatctaatgatcatcatgaaatgaataagagggcttaagaatttgkccatttgcattcggaaaagaatgaccagcaaaaggtttactaatacctctccctttggggatttaatgtctggtgctgccgcctgagtytcaagaattaaagctgcaagaggact

SEQ ID NO: 237 - DNA, 591 bp, Homo sapiens
  misc_feature 497, 505: n = A,T,C or G
tttttttttttttttttttttttttttctaatttttactttttctcaagtttaatgtaracatacaaraaaacatcaagcaatgtttattgkgcaattccaatcattatttgcaraatcttggtttaaagtcagtytttatagccatttcaactgcttggtttaaacaaaaagcaacaatctggttatytacctataaatttcatggtatttytttaaacactgaagtactaaaagcactgatgatttgtattataatttttaaaatatttaaaacctacacagatttcataratcattccttttataaaataatcaaaataatttgattatytggaaaaaaaaattcttgaaacaragccctttccaggtatyttcaatctctgtaaaaccccaaaccccaaacagagtaratgatgaaataaggatttctcagttgcccaagactgtctgaaatttaaggttgaaaaatggactggcgtttttcatgtttcctgngaattcanagcttacaggtggcatcaaaactcaaatctctgggatggctttacatggctttcactttgatttgtttcattttcatttgcttctt

SEQ ID NO: 238 - DNA, 252 bp, Homo sapiens
aaatggcttttgccacatacatagatcttcatgatgtgtgagtgtaattccatgtggatatcagttaccaaacattacaaaaaattttatggcccaaaatgaccaacgaaattgttacaatagaatttatccaattttgatctttttatattcttctaccacacctggaaacagaccaatagacattttggggttttataataggaatttgtataaagcattactctttttcaataaattgttttttaattt

SEQ ID NO: 239 - DNA, 153 bp, Homo sapiens
ccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcag

SEQ ID NO: 240 - DNA, 382 bp, Homo sapiens
aaaaaaaccatctaaaagtggttttttaatatatatattttttccaaaggaagaaatttcttgcttttactcagggaaaaaaaaaaattaaggtacatttgagtagaatgatttcatctaaaagagttctttcaggagacatctgtgattcactgcattgtttttattttcttctttttcctcttcttttccaacatttctaccattttcctcttcttggttgatatcaggccactttcttttgttgctttcttactgtcacctgttaaaccgcgtttctttgtgttaggttttgaccgcttttcttctttgtgcactgtgtcaccaggctcctttttgccaattttggactgttctttacttacaggagaaggctctgcag

SEQ ID NO: 241 - DNA, 400 bp, Homo sapiens
ggcatgagccaccgcgcccggccctatcttttacttttataaatagagatgaagtttcaccatgttgcccaggctggtatcgagctcctgggctcaagcgatcccccaaccttggccttccaaagtgctgggattacaagcgcgagccaccgaaattattcttaactagcaagactaggctctgacatcacatccttatagttacatccctttaagcagggttcagccactcactctgcacctggagaacttgatggttatccctcgaagtgacagtcctgcaaatgacaaaaacactccaaatctattaggttggtgcaaaagtaattacgctttttgccactgaaagtaagtcccacaggaccctgagggaaatgggagggtggggtatacatagcag

SEQ ID NO: 242 - DNA, 75 bp, Homo sapiens
actcacatatgcagacctgacactcaagagtggctagctacacagagtccatctaatttttgcaacttcctgtgg

SEQ ID NO: 243 - DNA, 192 bp, Homo sapiens
gctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttgg

SEQ ID NO: 244 - DNA, 616 bp, Homo sapiens
aattttatagcaatatactgaccattctaaaaataacaaaatacatgttgctctcaactacatagttaaaaaaggtagtaaattctcttacccaaaatagaggaggggtgggctagtgagctgctcaaacatttgtaacaaataaaaatgtatctatatacatataatgatcatgttttcatagcctaaaatcaccatacaaaatctaataataaaattgtgtcgtgttcaggagttgggaagccaacacattaaattaacaaagtatttttggtatatgtaaataatgggatagaatctctcgaatcaggattgtcccagaagttctaaggcagatgtcaatgacatgcacattgtccatgttcagtaattttcaaagactagaataaactatgtaaactattcaatacaattcaatattacttaactgctaaaaagtacttcaagatcttgcactgccttgagtgagtataatcaaattagtaattggaaaatagctgtaatagcaggcactgaagaattctgacaaataccaaataactgtttgtttttaccaaataaactggtaagatgatatcacaaagggttttaagttattttgctatacaaggttttt

SEQ ID NO: 245 - DNA, 165 bp, Homo sapiens
ttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaagg

SEQ ID NO: 246 - DNA, 229 bp, Homo sapiens
tgtactggatccctccaggtgggggcgactctcacctgactattacaatagcctcctaagtggtttccctacttgcaaccttgcccgtataatatctatcctccacacagcaggcagggcgatcctttaagaatagaagttagatcatgaaaatgctctgctctgatccctgcaaaagctcgccacctccttacagtcaccgctgaactcgtagcagaggttcaggagg

SEQ ID NO: 247 - DNA, 338 bp, Homo sapiens
  misc_feature 67, 206, 244: n = A,T,C or G
ggaaaccgtgtgtacttatcctggatgatgccaccagtgccctggatgcaaacagccagttacaggnggagcagctcctgtacgaaagccctgagcggtactcccgctcagtgcttctcatcacccagcacctcagcctggtggagcaggctgaccacatcctctttctggaaggaggcgctatccgggaggggggaacccaccancagctcatggagaaaaaggggtgctactgggccatggngcaggctcctgcagatgctccagaatgaaagccttctcagacctgcgcactccatctccctcccttttcttctctctgtggtggagaaccacag

SEQ ID NO: 248 - DNA, 177 bp, Homo sapiens
tgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaa

SEQ ID NO: 249 - DNA, 263 bp, Homo sapiens
aaagtaatgactttattaataaatatacatccatatgatgatgtagatacaaatcatgaacactactccattcccatacacataattgcacacgagtagctcaagttcatggacataaaaacatacacagtatctattcagactttttacagcagaggacagcgtgcttattatcagttaattggtaattattttctccaaaattacctgtggaaaaaagaaattctgaaaacttaaaagaatcaaagtgatctgattacttt

SEQ ID NO: 250 - DNA, 333 bp, Homo sapiens
aaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgcctcagaccatcttgtgagattgtttgcctatctcataatacagttttatgcagaaaggttgaaactatgtaaatggtttttatggaaattatcagttacaatatttt

SEQ ID NO: 251 - DNA, 384 bp, Homo sapiens
aaaccatttgtacaaaacttctataaatttttctctctctttctctcttatgtacaaaaatatcttaatatatccccgaactggttaggatagatacaaatagattttttataataaaaaattcacaaaagattggaagcattctataatgaaaatggtagaaaagacagtgtgagggaagccatggggtttgggaatcgggccctggaggagaagcagagtttcaaagggctgagaatagcatagtttcactgtaaaccaatgtctacagcttattggggtgggggctactgagacgaaagacaccaactcgtttctagagggctaagaactgcactttaagaaagggcggggaggtgaagggacccgagcaagaactttcag

SEQ ID NO: 252 - DNA, 211 bp, Homo sapiens
aaagcagtctgaaaatgggacatctgtagagaaattcatttccttcttctcctccggatgtggaatggaagctttgagggaaggaaaagtaggaaaagagcgggatgggatgggatgggatgggatgggatgggataggaagagaggctggggaatgggcagagaagggggtgctgagtgtgctgtgagatagagcaagatcacaagaagg

SEQ ID NO: 253 - DNA, 135 bp, Homo sapiens
aaaaattgtttcttgacaagctgacttggcacttaagtgcacttttttatgaagaaaaagtacaatgaactgcttttcctcaagcaataattgtttccaacttgtctgggaattgtgtgtctggtaactggaagg

SEQ ID NO: 254 - DNA, 361 bp, Homo sapiens
cctgtagcccctgctacacgggaggctgaagtgggaggatcacttgaaccaatgagggtgaggttacagtgagcccagatcatgccactactctacaggctgggtgataagagtgagaccctgtatcaaaaaaaagacaaggaaaaaaaaaactgggccgtttgtttttgcagaatgtctctcaatttggactttttgggcaggaatacaatacaagtgatacaaatgcttctttaacattagaacctgtataaaattaccattacagaccttgctattttacttataggtaaatcactgtttaccaaggtaagtcttttgggaatttccaaaaatgaagtccatggacagttaaaaactg

SEQ ID NO: 255 - DNA, 331 bp, Homo sapiens
aaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttccttttt

SEQ ID NO: 256 - DNA, 186 bp, Homo sapiens
  misc_feature 115: n = A,T,C or G
cctttgggcccttgcactttgacctgcaatggggccacaccagccttgcttgtgtccacctggaaggactgagggaggttggcacgaaccatgcctgggctcaggccgggcccanagcacttgaccttggacgcatctgtcacatcatgcacagggaccttgaaaggactgcctggcacttgatgg

SEQ ID NO: 257 - DNA, 255 bp, Homo sapiens
ctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccagagactcctccgactccacacctctcgcggcag

SEQ ID NO: 258 - DNA, 604 bp, Homo sapiens
ctgaatttgcaatggagtttggtggtgcaatcggtattgattagtttggcatagacagatgcagcagtttagagcaaaatcgagaaaatgattttttttttcctccttgatttcctggcagaagatatcttactttttcagcaaacttttcttttaacactaaagcagcctagggcaatgccagatacttagagcttttctcttgattataagtagaaatgggggtgtctgggctagaggtggagggtggatgtgctgtcgtcacagtctagctggcagcaagcaaggcaaaagcagagactgctctagaagcggttccaagcagcagagacgtcaggaaaggcacttcttagtaccaacctctatgctttaatagttgcttgttaagctgcttcatgggttgagacaaactaccagcacttcaaagagctcagttctctgctcaactctcttctctagttacattattttttttccttcaggagactgaggcaggaaaatcgcttgaactcaggaggtcgaggccgcagtgagccaagatcacaccaccgcactccagcctgggccttgcaaagtgctaggattacaggaatgagccaccagg

SEQ ID NO: 259 - DNA, 429 bp, Homo sapiens
aaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgcttt

SEQ ID NO: 260 - DNA, 385 bp, Homo sapiens
  misc_feature 179, 318: n = A,T,C or G
ctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaanacgcatatggcagacggatttgcgtataccaaggagagtggcataggagggaaaagcatatgtggctgaaacctgtaagttggtgttggttatgcagaaatgtgtaacagatcaaacggtcctctcaagtgtctattanataggcaataagaactgcagtgtagctgagtaacatcttttagctgactataaatcactttgttttt

SEQ ID NO: 261 - DNA, 230 bp, Homo sapiens
ctgtactggatccctccaggtgggggcgactctcacctgactattacaatagcctcctaagtggtttccctacttgcaaccttgcccgtataatatctatcctccacacagcaggcagggcgatcctttaagaatagaagttagatcatgaaaatgctctgctctgatccctgcaaaagctcgccacctccttacagtcaccgctgaactcgtagcagaggttcaggagg

SEQ ID NO: 262 - DNA, 198 bp, Homo sapiens
  misc_feature 88: n = A,T,C or G
atgttaagtaaacatgaaatctatataacagaacaaaaattcactcttatgtcaatgtcagcgtgttaatgtagatctatttactganacagactctgtagtggcagagagtggccttgttaagccaggaccctgttctgcaggctgtgggtagaagctaggaagtccctggagtttcacccagcttttccatgaatg

SEQ ID NO: 263 - DNA, 157 bp, Homo sapiens
aaaatatatttctaaacagaatgggccgactcagtcacagtaactgttgatctccatagtagagcaacccacaaagacagaactgatttttttcccataatcaggggtgaaaaatatacaacttgtttctgaaccaaaaccacaatttctgcagttt

SEQ ID NO: 264 - DNA, 290 bp, Homo sapiens
ctggctactccaagaccctggcatgaggctgaggacaacttacaagggcttcaccgaagcagtggacctttattttgaccacctgatgtccagggtggtgccactccagtacaagcgtgggggacctatcattgccgtgcaggtggagaatgaatatggttcctataataaagaccccgcatacatgccctacgtcaagaaggcactggaggaccgtggcattgtggaactgctcctgacttcagacaacaaggatgggctgagcaaggggattgtccagggagtcttgg

SEQ ID NO: 265 - DNA, 234 bp, Homo sapiens
aaaaaaaggaaaggaaagagaggaaaagaaaataaaataagacgatttattgcttctcctcagcatcctccttggtctcctccttcaccgagagagcttctagcttttccgccactttttcggcatgatcatttttgcctgatcctttcttttctctctcttcgatctctttcctgcattcttcaaactttgttttgaatttctgtgcattctcagcattcaggaagcggatgg

SEQ ID NO: 266 - DNA, 335 bp, Homo sapiens
gtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccagg

SEQ ID NO: 267 - DNA, 619 bp, Homo sapiens
  misc_feature 69, 86, 119, 205, 352, 547, 580, 611: n = A,T,C or G
tggagctctgacgaagggatcggggaggtgctggagaaggaagactgcatgcaggccctgagcggccanatcttcatgggcatggngtcctcccagtaccaggcccggctggacatcgngcgcctcattgatgggcttgtcaacgcctgcatccgctttgtctacttctctttggaggatgagctcaaaagcaaggtgtttgcanaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcanaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccanagaccatgtgtgagatgataaagatcatgcaanagtacggggaggtgacctgctgcctgggcanctctgcca

SEQ ID NO: 268 - DNA, 147 bp, Homo sapiens
cctataacccagacaccagcatggacaaaactcagttatactgaattcagagacaaaattcagtgacactcttctaccacttatttagggttctacagcatttcactgagcagacttagttttttgtttttgttttacaaacctttt

SEQ ID NO: 269 - DNA, 325 bp, Homo sapiens
ctgagctgtaggaatgggttcttggtacacaagatagtattgttgagctagttttcgagctctgtgcacaagcactctgtaatcggggcccatgccactgtacaccaaacctatatgcttggtaattggttctactttgtgtacacttcgctcatcatacagaatggatttctgttttttctcagttgctaataccacaccatttgcagctttaattcccacggacggggctcctccagctacagcagccaaagcatattcaatctggacaagtttaccagacgggctgaatgtagtcagcgaaaagctgtacccgcgctccgcc

SEQ ID NO: 270 - DNA, 428 bp, Homo sapiens
aaacatatggtaaattaccgagtgacacctctgggctagagacctcttttgaggggagtttgcaaactacggattcaatttctttaacagttatgaagttctttaaagaacctgtttggtattggggggttgtggtcacctgtgcttttctgagatttggcccctacatctaagttgttgaatgcatgtgtgtagagttgtttatggtgcttccctttcttcttagaagggtctatagtaatatcccctgccttatccctagtagtactaatttgtgttttcttacttcttgacaggcaaacacatcagagcataagtggttcctaatgccaagctgacctcccttgatctctgtcttctacaggatattgacatgggacttctttattaccttttcagttcactgataccttcaaatagctttattt

SEQ ID NO: 271 - DNA, 206 bp, Homo sapiens
  misc_feature 18, 21, 33, 118, 180: n = A,T,C or G
cgtcccggagcccacggnggncatggctggcanagcgctctgcatgctggggctggtcctggccttgctgtcctccagctctgctgaggagtacgtgggcctgtctgcaaaccagtgngccgtgccagccaaggacagggtggactgcggctacccccatgtcacccccaaggagtgcancaaccggggctgctgctttgactcca

SEQ ID NO: 272 - DNA, 83 bp, Homo sapiens
ctggcttccctgagaactcaacaatgccttttcctgagggccttcctcgatcatccacaatgactacagccctctctacctgg

SEQ ID NO: 273 - DNA, 472 bp, Homo sapiens
ctggagaaggtgtgcaggggaaaccctgctgatgtcaccgaggccaggttgtctttctactcgggacactcttcctttgggatgtactgcatggtgttcttggcgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctgctgtgagtccag

SEQ ID NO: 274 - DNA, 205 bp, Homo sapiens
ccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagcttttt

SEQ ID NO: 275 - DNA, 308 bp, Homo sapiens
ctcctcgccctccccaccgacatcatgctccagttccagcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgcttt

SEQ ID NO: 276 - DNA, 201 bp, Homo sapiens
aaattaactttttcttgcaaaatattcatttcattttttccaagaaaatcttataaaggcaaaaataaaattttattttggcaaatgtcatgaagtcgatactggcagcatatggagttagttaaaaatagacaacaactgctagatatattcaaaattctatttttttttctgagcatagtcaaagagaaattttcattt

SEQ ID NO: 277 - DNA, 520 bp, Homo sapiens
  misc_feature 32: n = A,T,C or G
aaaaaaaaagtattcagcaccatttgctcatnggtctttcagagtttgttcttaaagtttctggaactttcctgtctgtaaagtaacaggaattactgagctacattggaaagcctctctgggacaggcagtggggagttaagcagtcatcataaaggaatcagtgtacattcagcatggtgacttgactacacaacaatcccttcccctctactgtagctcaagagagacatgcttctaaccactgaggtatgaggagtctcagactgttatttgctgttagaattggtcttcccagctaataacagtacatctctggcacagatgctattggtccttaatgtcctgtgattttaggaaatagtttggatttagttcaatttattcagaaaccaaacgtgtttaattagcttcactactctggcagagtaagggtatgctggtttagtatctttataaaatatatataatgtataggtaaatcatagtcttaaatcatacctaaaatactgtatcattt

SEQ ID NO: 278 - DNA, 264 bp, Homo sapiens
cgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggccttgaagtaccatcctgataagaacccaaatgaaggagagaagttt

SEQ ID NO: 279 - DNA, 414 bp, Homo sapiens
aaacatacaataatttttattatggaaattaatctttacatacaaaatcagctacgtaattttacttacaaaacaataaaaactgttctttactgtggcaacaaaagaagcattttgacaaatgaaaaaaattaatgcaaacaaattaaaacaatgcttttctttttacttgcttcactgtctcttctatttattttctatgatcatttgacacaaacatggattactttgatatctactgaaacataaatgataaggttcttaaaggttgaattaaaagtctgggtgttcaatattttagaagctgaataaacaaaacgaaattggggtttgtgattacagaggatttatcattttttccctttgtccatatgaaaatatataatagaaaattacccacgggaaaacattttt

SEQ ID NO: 280 - DNA, 262 bp, Homo sapiens
ccaccatgcctggcctgcttcaattttttgatgccactttgtaaacggcacttaattatggaaaataggaaaaagcaaaactaaaataaggaagaggatatatatataacttttcacaatctcttttctgatcccctttagatgcccagtcaaccaggaccacacacagatttcattttatttgtagagtatatgaaaagatttaatagtctcatgcattttattttacgtatactgatttctacgttttgactgactattt

SEQ ID NO: 281 - DNA, 349 bp, Homo sapiens
ctgtgacccgggtgcatcagtggatatagttgtgtctccccatgggggtttaacagtctctgcccaagaccgttttctgataatggctgcagaaatggaacagtcatctggcacaggcccagcagaattaactcagttttggaaagaagttcccagaaacaaagtgatggaacataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcag

SEQ ID NO: 282 - DNA, 381 bp, Homo sapiens
  misc_feature 209: n = A,T,C or G
aaacactaaatgaagcttctcacaatttctaattataaacaaaaggctgaaaacagtatgggaaacaaagtttcaaaacaaagaaaagttgagtaaaaggtgccccctctatggctcatctgaaagaaacattttactcagagaggcaaacatttctgatctaggagtaagtttcccactcactttgcaaggacccactcattctgcanaaagacctacaagtctttctggtctcaattgcaaagtacgtgaaaatgtgtatgaaagatctaaaagctaaatattagaataaggctaattgaaatcaaaattgtgtgctggtctaaatatacatcttcggcttcttcctttttagtaagtatttttatttcagatgtattt

SEQ ID NO: 283 - DNA, 543 bp, Homo sapiens
aatatagctcctccctacccccaacaatggaccctgcccattgcctcccagttccttgatcttcctaggttccacaactctctttttccttttagttttattccctccagccaaacctctcttattcaatattttgagccaatgggggagttatgtagatttttttccctacacattagctggccccttttatgaccaatgactcataaggcaagatgtgtggtggcatcttcggacaggcagcaggctttaatagggcagcctgggttggtggaggcaagcaaagctaattggcatgcgtgggaatcaaaccccaggccctgggctcattagcccatggtcaaaacaactgagccagaggaggtaataatttgcccaagaatatcagtagttcctttattagaagaaaatggctgatatggaagttggggaatctgaattgccagagaatcttgggaagagtaataagctcttagtctcaacaaaaagtgttttttcatctcagcgcgtaaagggtgctatatgggaacaaagaagtatttt

SEQ ID NO: 284 - DNA, 147 bp, Homo sapiens
aaactggtattttatctttgattctccttcagccctcacccctggttctcatctttcttgatcaacatcttttcttgcctctgtccccttctctcatctcttagctcccctccaacctggggggcagtggtgtggagaagccacagg

SEQ ID NO: 285 - DNA, 316 bp, Homo sapiens
cggccgaggtctggcttcactcctactccctctctgctcgcagcacgtcggccgccagctctttgatgtgttcccaggcccgctgcacatgggcagattccaccgtgcgagaacagatggcaaagcgcaggacaaacttgtccctgaggtgacatggaaccaagtggatttttttggcactgtttattctttgcagaagagcttcattcactttgttggaaccctttagccgaaagcagacaagccccagaatgacttccacacagatttcaaagcggggatcctggcgcaccagtgactcaaactcatgggacag

SEQ ID NO: 286 - DNA, 322 bp, Homo sapiens
cctggggagccctttagtggggtgggacctcaggcagacccccaaaccaaagggagccagatgcccaagttcaagtcattagtgatatgtggcagggctgacagagaaataatcctggaggtctccaaagctgctgggaatggaatggcgatgaaaagcgcaggagtgggcagggtgtggtgggtgatggtggcctcactcagagtggaccaaggccccagctccttgcccaaaaccaaagcccttgggcccgaagtttttagcataacatcctttgcagtaaatctcgccatccttgtctgccagggtggttgactcaagg

SEQ ID NO: 287 - DNA, 364 bp, Homo sapiens
ctgcccacgctcaaaccaattctggctgatatcgagtacctgcaggaccagcacctcctgctcacagtcaagtccatggatggctatgaatcctatggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacgagtggatcagcattgataaggatgaggcaggagcaaagagcaaagccccctctgtgtcccgagggagccaggagcccaggtcagggagccgcaagccagccttcacagagg

SEQ ID NO: 288 - DNA, 261 bp, Homo sapiens
aaaattataactactcattctttctttagccttagttaatttgagcagaagccacaacaagcaaaccacaataaatttagaattggcagaaatccacattaactcctcttcccaagtttccacactactaccatttacagttgtaggtttgtaatgtataattatgtaatgcagaaactagctttgacttgtgtaacgatgcactgtcaaagtaagcaaagtaagaattgaaattccacattcccagaatttaacactcag

SEQ ID NO: 289 - DNA, 261 bp, Homo sapiens
ctgagtgttaaattctgggaatgtggaatttcaattcttactttgcttactttgacagtgcatcgttacacaagtcaaagctagtttctgcattacataattatacattacaaacctacaactgtaaatggtagtagtgtggaaacttgggaagaggagttaatgtggatttctgccaattctaaatttattgtggtttgcttgttgtggcttctgctcaaattaactaaggctaaagaaagaatgagtagttataatttt

SEQ ID NO: 290 - DNA, 92 bp, Homo sapiens
ccactacccgaacttacaggtgccaaaagaagaaagggtataaacggagaccacctatcactcatcagaacctaggatcatcacattccttt

SEQ ID NO: 291 - DNA, 287 bp, Homo sapiens
ccatggctccgctcagggccccggtcacctccgagtcactctgttccttgactgtctttgtgtttctgtacctcaaggcactgaagctggaggactctgtccatgcctgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccag

SEQ ID NO: 292 - DNA, 270 bp, Homo sapiens
ccattgtttcctcgctggcgaaggctccttgaacatccctcaccttcctctcccgcctctgccttctgctgggtcaaaggtggccttttctctccagccttgaattgttccctgttggcttcccaagggcccatctgctggtacagtccacacttccacagccaagacccgagagggctttcactgccccaagcctctctcctgtgaccctgggattctgtcttggcagaatcctttgtcagcggctcttactctgtccttcctgtttgg

SEQ ID NO: 293 - DNA, 333 bp, Homo sapiens
ccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagagg

SEQ ID NO: 294 - DNA, 123 bp, Homo sapiens
ctgatacaaatacagaaaactctgcccattatccaagaaacaaataattaagactaaaatgcaagctgatgtgttgcagcattgtagggccactaaatagccatctgtgattcgtggcaattt

SEQ ID NO: 295 - DNA, 311 bp, Homo sapiens
ctgcatacagacatttgtttaggtcatctggattatcttgattgtcaccatggcaactatccacaaccagtgcctaggtgtgtgagaagagtgatacaataatactgtggcatggtcatttagctaatccagtctaagcctaacagaaaccttttccatcaaagtttttcagagaataacaacatctcataagaggccagaggatggcttgtgcttaatatcacacctgtacagtagggcagtgcttcccaggctgtctgcttacattttagcttgtcttacggttacatatggttttagtattttcattt

SEQ ID NO: 296 - DNA, 241 bp, Homo sapiens
ctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggcttta

SEQ ID NO: 297 - DNA, 295 bp, Homo sapiens
aaacacaagatgaaaatactctgttctgtccaaagcatcacctaatggtgtgaggcatctcacttagctgtggagaagtccttggaattagatctcagaaagacagctttaagacagtaaaaccttttggcaatgggctaattgccttaaaagaagagttctacctgaaagaccttgcaggtggagaaattgtcctacaaagattcttggatatgttagtggagataactgacatgggtagctgtgggtcaaccaggaactgtcaacaacctgatctctgcaaaaccaggatgga

SEQ ID NO: 298 - DNA, 347 bp, Homo sapiens
ccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacag

SEQ ID NO: 299 - DNA, 268 bp, Homo sapiens
aaaaagtaaacatgaaaacatcacgaattgtaccatgattcaagaataacttttgtaatagaaaacacatgaccttttgcagtatagtgtgataccgaagtaaaagtgaaagaaataaatgcaggaaagtttaagtggatgtaagtttttataaggaaagtaataagaggaggctgcttttgaaggtcctttgatcttccatgatgataatatcgttgcaaagttctttaacttgtattcaagtaattagcagttgaccacttggttt

SEQ ID NO: 300 - DNA, 185 bp, Homo sapiens
aaattggagaaggaagttttcctgaagagccagaatccttgctaagtcatttagatccaactgaccatctttatttctgtcaaaaatcttcatcatggtgccggtgtattcttccagtttagcctcagaaatggcctttctgtggtgaagaaagaggtctcggaggaagttgcggagctcagcag

SEQ ID NO: 301 - DNA, 75 bp, Homo sapiens
aaaattggaaagtgggataagaaatctaaagtaaccagcttatctttgaaacaatattattttgaaattggcttt

SEQ ID NO: 302 - DNA, 247 bp, Homo sapiens
  misc_feature 159, 188, 212: n = A,T,C or G
ccatgttctctgaattgggtgcagaagacaagggcagagtggctgcggcccctattacctttgtagcagccacatcagaaagcagaagaaaacagtatttctgaaggcattgtttgaggttgatctcagcactgaacgatttcaagccctacgcaccanaacagaaggagggtggaggaagtgatcanagggaacgagctgtaggtttgcanaaatgtgtgaaaccaaaatgatcactgcctacttg

SEQ ID NO: 303 - DNA, 535 bp, Homo sapiens
ctgcttcagaggaaatcactgaaaaataaagaaaaaccatccatgcatggctgcatccagtgtacctgtaatcctgaagaaaaggtcctaattccttccatgctgaaatgctagctttggtttcagagagagactttattgcaactgtgaccaccgtcactggtgagcactgctgttcggcccccagcggacttaaaagactggaatgtggtagtggcggtcgttctcggtcagcagggagatctccggccagtccctgagaggctcctctgggtagcagacttcaaagtctctggagttaaacttgaacagtctgaacacttttatctttacttcaagggagtatccaagtataaacatatcaatctgctctagtccacatgtgtcgcctacagaattcaggtgattcatcatgaagctcaaaggatcagaggatgtctccctggaaaacaggagtctaaaaagactgggaatgacctttttagtcttcatttgttcataaacttcagtgacttgatacagcatgatgaacttt

SEQ ID NO: 304 - DNA, 522 bp, Homo sapiens
ccgcgctcggtctacaatcacgttttattattggctcgtctagtcatgggatagagaaggtaaatagcaaaatagaaagaaaagggggaaaaggtagaaggcaaggggaaaactattggttttagatctttatcctggtcctgtcaatgatcaggtaattggaaggatcaaaattaggccaaacttggtaattgggccaaaattgaaccaaagtttgtgtcaagaagacctggggcagagatatgtgactaaatcatttggaatatgcccagaccccaagaatatttatgcccaacttgaatgctaaccagaagtcccttactgtagaagattgtaaggttgctatttttttgccccgacaccaaaatattgatgtattttccaacaccaattctccaattctctgacaccaactcgatgttcaacaattcagttatattctgtcactaattcctgcagctatcagcaggccccacaggtaaaggattcagtctcacaagattgcccccccacccacttcag

SEQ ID NO: 305 - DNA, 165 bp, Homo sapiens
cctaaagcgctcctcgctgaagctcaaggggtccacaatgatttgtttgtcaaagttattgagtgcatatgccagttctcctcctcctccaccctggtgctgtgaggcatcgtctgaggcagtggcctgggctgcattggaaatgcctgtgaccgcctgctgcag

SEQ ID NO: 306 - DNA, 294 bp, Homo sapiens
ctgcacctaagacatggccctggctaggcgggaacagctcacagtagcgatacattcacaggacacagttggtgtccagaaaagggggctcagaacacagtttctacacaagcacttggcacccacacgacagagacgtcactcaagcagcacagccacaaatagtttacagcagctcatgcccggcatccgcccatgctgggagactccctgaaaggtgggcacctgccgtctatgaggaggtgtctccctccatcattaaccccaaaccacacaatgtgtgaggagagcagg

SEQ ID NO: 307 - DNA, 181 bp, Homo sapiens
aaaaatccatgacaccttgatagaaattagagtttacacaaacaaaaaaggaaccttcgatattgccagcagctataaagtgaacgtactgagaccgacaggacagcaagaaggcatttgcacatttatatctgacacccgaccatactttcagtcaccagaatatcttctctccagattt

SEQ ID NO: 308 - DNA, 179 bp, Homo sapiens
  misc_feature 138: n = A,T,C or G
aaggctgaggactgctgggagctcagatcagcccggagctactggctcatgggcagccaaaaaatactggatctgctgaacgaaggctcagcccgagatctccgcagtcttcagcgcattggcccgaagaaggcccanctaatcgtgggctggcgggagctccacggccccttcagcca

SEQ ID NO: 309 - DNA, 129 bp, Homo sapiens
  misc_feature 28: n = A,T,C or G
ctgcccgcttgcccgtagctgactcagnttcctcatcttcatctccatcctcttcctcaccatcaccttcttcttcctcctcctcttcctccccaccttcttcctcttcttcgtctacctcattgtcag

SEQ ID NO: 310 - DNA, 390 bp, Homo sapiens
tgaggctgggggagagccgtggtccctgaggatgggtcagagctaaactccttcctggcctgagagtcagctctctgccctgtgtacttcccgggccagggctgcccctaatctctgtaggaaccgtggtatgtctgcatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaagg

SEQ ID NO: 311 - DNA, 355 bp, Homo sapiens
  misc_feature 127, 131, 154, 156, 192, 204, 227, 242, 271, 274, 297: n = A,T,C or G
cctctctgtgctgctgaaggcagatcgcttgttccacaccagctaccactcccaggcagtgcatatccgcctgttgagaaatgccgtgtctagattgtggacaagagcctgcgtgattatgctatangganaaaaattcttcgagttccacccnanctcctctaaacatttggctcactcaaaacaaaaagncaccaatcttantactgctgaacttcatttatgtnacctaacattaaccntcgtaggaaaaccaaatagccctctcgtncangatatgttgctaaaggactaccntgttcaacacaacggctccggtgtgtgaactcctgtttgggtgattcccctactctca

SEQ ID NO: 312 - DNA, 498 bp, Homo sapiens
ccattcttttgaatctaatctattatcaatagcatcctccataatatctttgataaaaggtgtccaccgagagagctgaaaagtttcttctgcagaccgatcctttcttaacggtttgccttgttgagattggggaacaatgggaacaccaaggtaactccagttacgaatcatgtcactctcattttctatctttacattctggatcaacctgtccaaattttcttccgtagttccattaatactgaagatataaagtagaattgctcttattttatcacaattatcatgatttttgttgagtagaactggaaggagtactcgcatggaatctttcaccttctgtccttctgcatcagttccaagtgccaggtcctgttcagttttgcagagcttttctatattaagcttgaacttattcatgcaatcttctgctaagttaagatggacaacttgcttagtaatctgttttcggaaatagggcatctttttcatcag

SEQ ID NO: 313 - DNA, 653 bp, Homo sapiens
aaacttatcagatttttttaagttaggtaatttcaatccacagtggctccatatggttaaaaaaacaaaaacaaaaacgcatttaaggatacacgaagcagtgaaaacaaagccccagtattttcgctaaagtactggaaatacctgtttctaaaaacagctttatatttgtccactgcctagaatagctctcacccaaacctcaaaaataagagcagatagattttagaagcaagaaaaggtaaacagtgcccatattatttgagactggctctgctgccctccctaagccagtttacattctttgagattcttggagtgggtgagtcagggctgaagactgcacaggccatgtcccctgctccaactattcctcagaacgtcccaggtggagggagtggcctgtcgattttcactcattccatggagctctgtgtacatgaaaattcctccaagtgtggcttttgtcgaattcagagatacagcaagccacgcataaaacatggagtgtagagcactggtgtacctagcttagaaacaccctcggtgaatgtggtactgtggctcgaaaggaagcaagggacaggacccaggagactgggcggccaggctctcggagttccacacacacctgtgaagcccggccagcacag

SEQ ID NO: 314 - DNA, 513 bp, Homo sapiens
ctggaagattttgctgcatttggcattatactgtaatttacagtatacaacatctggggactcagtactatcttagcacagactaacttctcccactccgtcagaggtggcaggtggcgggtcggtggggagggccttttctccccataaatgcctgaactttaatttataccatataagaaatcagtgaaaggtaaacaacaaggttaatgtaactctattataaattttgcattttttttctctgtgacatatacaagtatatttttgtttttggagctataaattatttaatttagcaatcttcaaagctcataaatttcaacttttcaaataagaaattttaacttcaaataagaagtctaggactttatggctattaattttactatcaaaatatccaagggactccattcaatgtaatagttataattcttctaaatatcatttgaataattctttgtggacgctagactcaagactatgctacatccaaacagtacatctataacc

SEQ ID NO: 315 - DNA, 222 bp, Homo sapiens
  misc_feature 15: n = A,T,C or G
atttatattcaaggnatctcaaagaaagcattttcatttcactgcacatctagagaaaaacaaaaatagaaaattttctagtccatcctaatctgaatggtgctgtttctatattggtcattgccttgcaaacaggagctccacaaaagccaggaagagagactgcctccttggctgaaagagtcctttcaggaaggtggactgcattggtttgatatgttt

SEQ ID NO: 316 - DNA, 1633 bp, Homo sapiens
cgtggaggcagctagcgcgaggctggggagcgctgagccgcgcgtcgtgccctgcgctgcccagactagcgaacaatacagtcgggatggctaaaggtgaccccaagaaaccaaagggcaagacgtccgcttatgccttctttgtgcagacatgcagagaagaacataagaagaaaaacccagaggtccctgtcaattttgcggaattttccaagaagtgctctgagaggtggaagacggtgtccgggaaagagaaatccaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaacaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatatttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttagaactcttctctactataacagtcaatttctgactcacagcagtgaacaaacccccactccgttgtatttggagactggcctccctataaatgtg

SEQ ID NO: 317 - DNA, 4235 bp, Homo sapiens
gaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatgttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagtgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatatcttagactcgatgctgtataaaatattatgggaaaaaagaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacattatttcttggtttccacttgcaatggttaattaagtccaaaaacagctgtcagaacctcgagagcagaacatgagaaactcagagctctggaccgaaagcagaaagtttgccggaaaaaaaaagaccacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataagaaaactgaaatatgtcttcaaaaaaaaaaaaaaaaaaaaaaaaaaaaaaaaaaaaaaaaaa

SEQ ID NO: 318 - DNA, 3347 bp, Homo sapiens
atcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagcccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgaaaaaaaaaaaaaaaaaaaaa

SEQ ID NO: 319 - DNA, 1814 bp, Homo sapiens
ggggagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaagctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggcgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagctt

SEQ ID NO: 320 - DNA, 3132 bp, Homo sapiens
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaacggtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtatcccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaaaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttcttttttttttttgaaagtgttttttcttcgtccttttggtttaaaaagtttcacgtcttggtgccttttgtgtgatgccccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 321 - DNA, 2280 bp, Homo sapiens
ccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttttgcaacctgataccttgaaaagcttctatgtgtctctccttttgttgcctggcagctgtctaggatgatcactgattactatttactaagtagccacatgcaaataaaagttgtttggtaaaatggaaaaaaaaaaa

SEQ ID NO: 322 - DNA, 1398 bp, Homo sapiens
tagatggcaacctccctatctgcccgcaggtcatagaggcgacacgtagcgtcatctgaccctgaagcaaaggcatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaaggcacgaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacaggctgtaagaatcaaagtcaactgacatctatgctacatattattatatagtttgtactgagctattgaagtcccattaacttaaagtatatgttttcaaattgccattgctactattgcttgtcggtgtattttattttattgtttttgactttggaagagatgaactgtgtatttaacttaagctattgctcttaaaaccagggatcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaa

SEQ ID NO: 323 - DNA, 1316 bp, Homo sapiens
acttctacctgctcactcagaatcatttctgcaccaaccatggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaacaaataataatcataaaaaaaaa

SEQ ID NO: 324 - protein, 200 aa, Homo sapiens
MAKGDPKKPKGKTSAYAFFVQTCREEHKKKNPEVPVNFAEFSKKCSERWKTVSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEQEEEEEEEEEEEDE

SEQ ID NO: 325 - protein, 263 aa, Homo sapiens
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 326 - protein, 539 aa, Homo sapiens
MPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGEKTAGINVRKGGISNILEELVVQPLLVSVSALTLATETVRSILKIDDVVNTR

SEQ ID NO: 327 - protein, 144 aa, Homo sapiens
MAFTFAAFCYMLALLLTAALIFFAIWHIIAFDELKTDYKNPIDQCNTLNPLVLPEYLIHAFFCVMFLCAAEWLTLGLNMPLLAYHIWRYMSRPVMSGPGLYDPTTIMNADILAYCQKEGWCKLAFYLLAFFYYLYGMIYVLVSS

SEQ ID NO: 328 - protein, 138 aa, Homo sapiens
MPNFSGNWKIIRSENFEELLKVLGVNVMLRKIAVAAASKPAVEIKQEGDTFYIKTSTTVRTTEINFKVGEEFEEQTVDGRPCKSLVKWESENKMVCEQKLLKGEGPKTSWTRELTNDGELILTMTADDVVCTRVYVRE

SEQ ID NO: 329 - protein, 346 aa, Homo sapiens
MFLSILVALCLWLHLALGVRGAPCEAVRIPMCRHMPWNITRMPNHLHHSTQENAILAIEQYEELVDVNCSAVLRFFFCAMYAPICTLEFLHDPIKPCKSVCQRARDDCEPLMKMYNHSWPESLACDELPVYDRGVCISPEAIVTDLPEDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENCLVEKWRDQLSKRSIQWEERLQEQRRTVQDKKKTAGRTSRSNPPKPKGKPPAPKPASPKKNIKTRSAQKRTNPKRV

SEQ ID NO: 330 - protein, 826 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 331 - protein, 92 aa, Homo sapiens
MAYRGQGQKVQKVMVQPINLIFRYLQNRSRIQVWLYEQVNMRIEGCIIGFDEYMNLVLDDAEEIHSKTKSRKQLGRIMLKGDNITLLQSVSN

SEQ ID NO: 332 - protein, 235 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKKKKMPKLRFASRIRKIRKKQF

SEQ ID NO: 333 - protein, 291 aa, Homo sapiens
MQRARPTLWAAALTLLVLLRGPPVARAGASSGGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 334 - protein, 582 aa, Homo sapiens
ESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 335 - protein, 709 aa, Homo sapiens
MAEVEDQAARDMKRLEEKDKERKNVKGIRDDIEEEDDQEAYFRYMAENPTAGVVQEEEEDNLEYDSDGNPIAPTKKIIDPLPPIDHSEIDYPPFEKNFYNEHEEITNLTPQQLIDLRHKLNLRVSGAAPPRPGSSFAHFGFDEQLMHQIRKSEYTQPTPIQCQGVPVALSGRDMIGIAKTGSGKTAAFIWPMLIHIMDQKELEPGDGPIAVIVCPTRELCQQIHAECKRFGKAYNLRSVAVYGGGSMWEQAKALQEGAEIVVCTPGRLIDHVKKKATNLQRVSYLVFDEADRMFDMGFEYQVRSIASHVRPDRQTLLFSATFRKKIEKLARDILIDPIRVVQGDIGEANEDVTQIVEILHSGPSKWNWLTRRLVEFTSSGSVLLFVTKKANAEELANNLKQEGHNLGLLHGDMDQSERNKVISDFKKKDIPVLVATDVAARGLDIPSIKTVINYDVARDIDTHTHRIGRTGRAGEKGVAYTLLTPKDSNFAGDLVRNLEGANQHVSKELLDLAMQNAWFRKSRFKGGKGKKLNIGGGGLGYRERPGLGSENMDRGNNNVMSNYEAYKPSTGAMGDRLTAMKAAFQSQYKSHFVAASLSNQKAGSSAAGASGWTSAGSLNSVPTNSAQQGHNSPDSPVTSAAKGIPGFGNTGNISGAPVTYPSAGAQGVNNTASGNNSREGTGGSNGKRERYTENRGSSPSQSRRDWQSA

SEQ ID NO: 336 - protein, 480 aa, Homo sapiens
MIRAAPPPLFLLLLLLLLLVSWASRGEAAPDQDEIQRLPGLAKQPSFRQYSGYLKSSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 337 - protein, 543 aa, Homo sapiens
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 338 - protein, 148 aa, Homo sapiens
PPATSYAPSDVPSGVALFLTIPFAFFLPELIFGFLVWTMVAATHIVYPLLQGWVMYVSLTSFLISLMFLLSYLFGFYKRFESWRVLDSLYHGTTGILYMSAAVLQVHATIVSEKLLDPRIYYINSAASFFAFIATLLYILHAFSIYYH

SEQ ID NO: 339 - protein, 196 aa, Homo sapiens
MPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKKTESDLLPCKAEEIYKAFVHSDAAKQINIDFRTRESTAKKIKAPTPTCFDEAQKVIYTLMEKDSYPRFLKSDIYLNLLNDLQANSLK

SEQ ID NO: 340 - protein, 316 aa, Homo sapiens
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHKKTAAQVLIRFHIQRNVIVIPKSVTPARIVENIQVFDFKLSDEEMATILSFNRNWRACNVLQSSHLEDYPFNAEY

SEQ ID NO: 341 - DNA, 422 bp, Homo sapiens
  misc_feature 6, 10, 13, 15, 29: n = A,T,C or G
gatganattnttncnagagagaggaagangctattcagttggatgggattaaatgcatcacaaataagagaacttagagagaagtcggaaaagtttgccttccaagcccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagacctgctgcatgtcacagacaccggtgtaggaatgaccagagaagagttggttaaaaaccttggtaccatagccaaatctgggacaagcgagtttttaaacaaaatgactgaagcacaggaagatgg

SEQ ID NO: 342 - DNA, 472 bp, Homo sapiens
  misc_feature 109: n = A,T,C or G
ctggagaaggtgtgcaggggaaaccctgctgatgtcaccgaggccaggttgtctttctactcgggacactcttcctttgggatgtactgcatggtgttcttggcgctgnatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcctcaaagcccgacccccacagcactgtctgaaggaggaggagctggaacggaagcccagcctgtcactgacgttgaccctgggcgaggctgaccacaaccactatggatacccgcactcctcctcctgaggccggaccccgcccaggcagggagctactgtgagtccag

SEQ ID NO: 343 - DNA, 139 bp, Homo sapiens
gtcctgggccttccccttccctcaagccagggctcctcctcctgtcgtgggctcattgtgaccactggcctctctacagcacggcctgtggcctgttcaaggcagaaccacgacccttgactcccgggtggggaggtgg

SEQ ID NO: 344 - DNA, 235 bp, Homo sapiens
ctgcgggctcagcacagtagacatgactgggatccccaccttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacatccacatcagg

SEQ ID NO: 345 - DNA, 458 bp, Homo sapiens
ctgtaaggtgctattcagtcctgtgacccttattttggaatgctcttcattactgttgctctgttttgtgacttcctgggaaaccgcctactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcg

SEQ ID NO: 346 - DNA, 525 bp, Homo sapiens
  misc_feature 41, 42, 47, 48, 49, 161, 316, 324, 326, 327, 379, 455, 509: n = A,T,C or G
ccagagcacaacgcctcaccatggactggacctggaggatnntcttnnnggtggcagcagccacaggtgtccactcccaagcccaacttgtgcagtctggggctgaggagaagaagcctggggcctcagtgactatttcttgtaaggcttctggatatatncttactaaatatactttacattgggtgcgccaggccccccccggacaaagacctgaatgggtgggatggatcaacactggcattgataccgttaaatattcacagaagtttcaggacagagtctccattacctgggactcatccgcgaccacagnctacctgnanntgagtagcctggaatccgaagacacggctgtgtattactgtgcgagacttanggcccgttcgctgtggtgggacttaatgacgcttttgacatctggggccaagggacagtggtcaccgtctcttcanggagtgcattcgccccaacccttttccccctctctcctgtgaagaattccccgncggatacgagcagcgt

SEQ ID NO: 347 - DNA, 423 bp, Homo sapiens
ccagacgctgacttgtttctgagtccttaagcaggaaggatttgaaatcctggagcttggcagtcttgctcttcacctctaagccaatgttgaccccttcatctataaagtccacaactctccggaagtcatcctcacggaactgtcgagaagttaaggctggggccccaagccgcaggccgcccggtgtgatggcacttcggtctccaggacaggtgttcttgttggcagtgatggatacaagctctagcacccgctcagcccgagctccatccaggcccttgggccgcaggtccaccagcaccaggtggttgtcagtaccacctgataccagtgagtagcctcgctctagcagggcatctgccatggcccgagcattcttcagaacctgcagggagtactcccggaacatgggggtgcagg

SEQ ID NO: 348 - DNA, 513 bp, Homo sapiens
cctctaggcctgatgctctcagaggcaatagaagaaaagtaaaaggaaggtctcacttcacagacaatgaaaccctcctaaccctcttccccactacccacaactccctacactgccaatctaaataaaaagaggacaatgcatgagtgtgagatacacatacacacacacacatacacacacacacacgcacagcttcctttcagccaaagaactgcaaaatccttccccggaaggaggacaactggcaacaccaatcaaggcttggtggtctaaggtgatggctggaatcatgtgagactggtaaaaatccagggagaaaatgtttcaccttcagctcattcccaagtctctatgaagcccgccccacttccacataggggaactgtggctctgggggcagcctctgcagctactcagaataggtgggaggaggggctggctttgaggctgccttagccatgaggctctttgcctaggaatagctggagatgggagctgcagggggctcag

SEQ ID NO: 349 - DNA, 231 bp, Homo sapiens
ccttatttctcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagagtaggattgcgctgttatccctagggtaacttgttcc

SEQ ID NO: 350 - DNA, 341 bp, Homo sapiens
ctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacacccaagatctgctcttggaatgtggatgggcttcgagcctggattaagaagaaaggattagattgggtaaaggaagaagccccagatatactgtgccttcaagagaccaaatgttcagagaacaaactaccag

SEQ ID NO: 351 - DNA, 256 bp, Homo sapiens
ggcgttggggacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtgg

SEQ ID NO: 352 - DNA, 368 bp, Homo sapiens
  misc_feature 21: n = A,T,C or G
cctttcttgtaagtgaagaanaaggaatgcagcaaagaagagttcgacattggagtccttagttccatcaggatcccattcgcagcctttagcatcatgtagaagcaaactgcacctatggctgagataggtgcaatgacctacaagattttgtgttttctagctgtccaggaaaagccatcttcagtcttgctgacagtcaaagagcaagtgaaaccatttccagcctaaactacataaaagcagccgaaccaatgattaaagacctctaaggctccataatcatcattaaatatgcccaaactcattgtgactttttattttatatacaggattaaaatcaacattaaatcatcttatttacatgg

SEQ ID NO: 353 - DNA, 368 bp, Homo sapiens
ctgaggggtggcagtaagcaatgaggatgggctataaagctgttaactggctaagggccatccttgggcaggcatttcagacacatctgtagagagggcagtagcatctccgataggccagctctgaaggaagcttaatgcttaatacagtcacactgcataaattagcttagaatgctctcttgggtaaaaaatattaatagtgtatatgcacttgaagagcaaaattcctcaagaaaaaaagtttaatagcaaggagtttccatcagtcccggtctttgtgaggattaccacaacaaacacttaaaaggatacaacaggtacttattaaatgctgccttgccttttacctcttccttttttttttt

SEQ ID NO: 354 - DNA, 380 bp, Homo sapiens
ccatggcttctcacccagacagtctttctgggcaacttggggaagcccctgttctgctcaagtctcaccccatggaagaggtgggggaagggggccttggtttttcaggaagacaggttggagagcacgagtcactacaaagcagtaaaagtgaatggtgtctccaggggctgggtccagaacaccacggagagccccagccataaaggtgtgttccgcctctggcctgcaggaatctctttgaatctctttgattggtggctccaagagcaatgggaagtcaacagccaggaggctggactgggttccctgggaccccgaggtcccagagctgctgggcagtggttgtcggcaaagaagaaaggtccaagagggtcagg

SEQ ID NO: 355 - DNA, 347 bp, Homo sapiens
ccagtggaggggtgggggtatcgatcccgccgggggctggcttggttgctggtgccctgagcccttctctgcccgcctgggtgttgccttcactgatggaggtaggcgtccagccagatgtcaccagacttcttcggggacctgacgatgtccaccagcgcggtgaggaagggcttcacttcgtagctgaggccgtgcttggcacacagcgacttgaccagcggggccacccggctgtagttgtgtctcggcatcctggggaagaggtggtgctcgatctggaagttgaggtgcccgctgaaccagttggtgaaaagtgagggctccacgttgcaggtggctgccag

SEQ ID NO: 356 - DNA, 157 bp, Homo sapiens
cctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccag

SEQ ID NO: 357 - DNA, 323 bp, Homo sapiens
ccatacagggctgttgcccaggccctagaggtcactcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctgg

SEQ ID NO: 358 - DNA, 555 bp, Homo sapiens
aaaaggtttctaaaacatgacggaggttgagatgaagcttcttcatggagtaaaaaatgtatttaaaagaaaattgagagaaaggactacagagccccgagttaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaccac

SEQ ID NO: 359 - DNA, 549 bp, Homo sapiens
ctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctcttgctgcttgagagctattgctttggt

SEQ ID NO: 360 - DNA, 289 bp, Homo sapiens
tttaaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgtttttaaaacagaattaggaatttgagatatctgattatatttttcatatgaatcacag

SEQ ID NO: 361 - DNA, 311 bp, Homo sapiens
ctgttcagtatggcaaagggcagacttactccttcatccactctgctgccttgatgaggtgaacacactggaataagatggagggcaggatacctgccaaagcctgaggaatgagatgatctgaaacaattgggcaaaggctggacatttcaaaaagctgacttccaactgcagtttatgggtatagaatttgatgcttccctcaagtcctgactgctctttctgaggcagccaggctaggccaagaaatgagctgctccagcttctccagagcacagcagcctcccagggcctgtcagcatctgcagcag

SEQ ID NO: 362 - DNA, 496 bp, Homo sapiens
  misc_feature 14: n = A,T,C or G
ccagtttctaaaanaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagcgtgtcctctgtattgcggtagatttatacattctgttgcctaaatatgtgtgtaaaatgagctgataaactggagtactacttaaaaaaaagtctgtgatttataagatgcatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttgg

SEQ ID NO: 363 - DNA, 673 bp, Homo sapiens
  misc_feature 16: n = A,T,C or G
ccaagagggagataanacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggctttgtgcatagtgtcttcatgtcgcgtatagttgagcgcgttcttagcagttggcttcatggacagctcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgcgcaaagcttaacaatttgtaggaaactttggg

SEQ ID NO: 364 - DNA, 495 bp, Homo sapiens
  misc_feature 13: n = A,T,C or G
ccaaatgtttgcncaagactagcagagtttttcttttaaacattctgtatgaaatatgtcagactgggggacgggggatctcttctaattcattgtttttcttttaaacattgtgcacaagcttatattcacatagaaagcatatacatcttataaatcacagacttttttttaagtagtactccagtttatcagctcattttacacacatatttaggcaacagaatgtataaatctaccgcaatacagaggacacactatccagaaaagaatgaacaaagaacaggctgttgcaaaaatatttagtccctttacacatatagtcaaacttcattaatgcaaaaaatgtagtggttattaaatgtctgaaagaatcagtatgtatgattgagattgttaatctctgagtataacacatattgttcatctcagagttgttttgttttaaagccgtggtagatgcttctctttaaatgtgcattttttagaaactgg

SEQ ID NO: 365 - DNA, 291 bp, Homo sapiens
aactgacaagcccttgcgcctgcctctccaggatgtctacaaaattggtggtattggtactgttcctgttggcccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcag

SEQ ID NO: 366 - DNA, 277 bp, Homo sapiens
ctggatggtgcctcagaaggtgcattctgcttctgcaggggcttgaaacaccaaggcactccagggatcctggagtcaaagcagcagccccggttgttgcactccttgggggtgacatgggggtagcccgcagtccaccctgtccttggctggcacggcacactggtttgcagacaggcccacgtactcctcagcagagctggaggacaagcaaggccaggaccagccccagcatgcagagcgctctggcagccatgaccaccgtgggctccgggac

SEQ ID NO: 367 - DNA, 311 bp, Homo sapiens
ccagagctgcggggcctcagtacacggagctgttccggatgccacagcacagcaccatgctcaggatcatctcgaagatcatgatcacagcgaccacgatggcagcaatgccgatgaggtacagcttcccggagaagaggtcatcgatcttctggtggcagtcctccttgaagaggttgctgatgatgttgctgcccgagggacacaaattgttcttgagcactgaggtggtcaaagcagtcagtgtgctggagccacagcagtcaagcgtctcgtggaaggtcttcaccacagccttggcgttgttggcg

SEQ ID NO: 368 - DNA, 384 bp, Homo sapiens
ccaaaggggtctctagctgctgctctgctgctcctgctcatggatgagtttggcgatggggccggtgatgccgcctatcaaggtccagtactcatcgaagctgatgcgcccatcaggattggcatccaggttctggatgagcttatccgcagccttccggttccctgtgtccgacagcatgtggttcagctctttctggagcatctcgcggaagctgctcttgctgatcttgttcttgaccaggctgtacctagacacatatttgtagaagttttccaccaggacaatgactgccttctccagctccgtgtagcaagtctgacatctccctgcttcgcctgctggcggggcctaaggcgggggccaagcccagttacagcccag

SEQ ID NO: 369 - DNA, 216 bp, Homo sapiens
ccaagtgccaggtggctttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcag

SEQ ID NO: 370 - DNA, 561 bp, Homo sapiens
ctggctccttcttttgtggtcgtttgggggatgggctggtttggggtttaggtgcagagaatggtttggggccactgcgtactggaccactctgagccttcagggcagggttcttgtgagtcttcatgtcatcagatacatgtttcagggcatgtgtaatgctctccccctgattaatctgcgcgaacagtgctgagcgggaagcagactcatctgagcctgaactggtagagactgggggaggaggggggcctggtggagggggaggaggacctgatccggcagagggtccagatggcagtccgctcagttcttttgccacaggccccgttttgctccaggccagtccggtggtatggaactccttaatgtaagcctgcagctctgtccatatacttaaataagctttgacccagtctacatgcttcttatccacatctttgtactctttgaggactcggtttgtataaaacatggcggcatcattcatttctttcgcataagggccaggcttgggagccatagccacccagcccagggcctggatactttcgctgacag

SEQ ID NO: 371 - DNA, 518 bp, Homo sapiens
cccacttccatcgctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcag

SEQ ID NO: 372 - DNA, 335 bp, Homo sapiens
ctggaggctgggtgcaccctgcccagatccacacctgtaccccggcggaaaggctcatgggcattgaagacggtggtgaaaaagccaaagggaaaagcaccaacaccaaatgagaagtggaagcccccggtatcaccaaatggctggaatccccctctgctctccggagctggtctctggccctgggggcggggtggagtttttaatctgggatcctggggcttctggctccctcgcccataaagcgggacaaccttctctctgctgatcccagctttacatactggacactcttgccgttctggccgtgtctccagccactgatgaagacatgg

SEQ ID NO: 373 - DNA, 467 bp, Homo sapiens
ccactagctgaatcttgacatggaaggttttagctaatgccaagtggagatgcagaaaatgctaagttgacttaggggctgtgcacaggaactaaaaggcaggaaagtactaaatattgctgagagcatccaccccaggaaggactttaccttccaggagctccaaactggcaccacccccagtgctcacatggctgactttatcctccgtgttccatttggcacagcaagtggcagtgtctccaccacctatgatggtgatgcagcccctagaagtggctttcaccacctcatccatgagagctttggttccccgggcaaaagcttcccattcaaatacccccacaggaccattccacacaatctgcttagcccgagtgacagcctcagcatacttcttgctgctttcaggaccacagtccaagcccatccagccagcaggtacgccagaagccacagtggcttgg

SEQ ID NO: 374 - DNA, 284 bp, Homo sapiens
tttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttgg

SEQ ID NO: 375 - DNA, 307 bp, Homo sapiens
cctactcttctccgtccattgtactatctgcccgtggtggggatggcagtaggatcatatttgatgacttccgagaagcatattattggctccgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggagg

SEQ ID NO: 376 - DNA, 650 bp, Homo sapiens
  misc_feature 7, 10, 13: n = A,T,C or G
ccattgnctnctnacgtgatgtcatcatctgccaggtcatcttggcaaaagtcggagcatttctcagtcactgcaaagtagcccttctcgttggagcaccggaagagacgtgtgtgtttcatgtactcggcatcgtcatcatagggcttctgtgccccaatgcccacccagaagaagttctcaggctcctcaccttcgttgataacctgcttgctgtaggaggtgtcaaacatggtgttcaggatgtcttctgccaacttggcttcgtcagggtctgatgcccggcccacccaggcatacacgatgccctggttgtcctcactctcaaagggaaccttgaggatgaagcagaactcggagttgaggaggctggagtcggtgttgatctggatgcaccgggtgcagagggcgctgccgttggtgcggatctggtagaggctgggctgttgggcgccctggaccgccttcctcttgccccggtggatgatgaacttcctcttgaaatgggacaggaacttggggttctcctgctgctgcgtcatgcgtaccacctccagcttcccagggaagaggctctcgaacttcttttgcaggctgaaggtgaaggtgacccacccatattgggaggctttcacggccctgccagaagt

SEQ ID NO: 377 - DNA, 306 bp, Homo sapiens
  misc_feature 38: n = A,T,C or G
tctagatgcatgctcgagcggccgccagtgtgatgganatctgcagaattcgcccttcgagcggccgcccgggcaggttcgggtgctgccttcacctgccaggcccttccccgctagcttggggcgagcagagctgcgtccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcga

SEQ ID NO: 378 - DNA, 199 bp, Homo sapiens
  misc_feature 6: n = A,T,C or G
ccacangtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtgg

SEQ ID NO: 379 - DNA, 216 bp, Homo sapiens
  misc_feature 9: n = A,T,C or G
ccagggcangtcatcaagaggggcattgtcttgcatgcggcctgccgtgtccaccagcaccacgtcaaagccttggttacgtgcaaaagcaatggcttccatggcaatgccagcagcatccttgccatagcccttttcaaacaactgcaccatggtgcggccaccatgcttctctggagggtgtagggcactcaaacgccgggtgtgtgtacgcag

SEQ ID NO: 380 - DNA, 555 bp, Homo sapiens
ccatgggccttcctttccactaaaaggaattccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcagggtcagagaagattcttcatgggaaatcaagttctaaaggctttgccccaagagatgatgaggcag

SEQ ID NO: 381 - DNA, 406 bp, Homo sapiens
ctgcaccaggtgggcctctaggtcccattaagcccattggtccagggccaagtccaactccttttccatcatactgagcagcaaagttcccaccgagaccaggggggccaggaggaccaggtggaccaggagggcctgtgggaccatcttcaccatctctgcctggggggcctggtggacccctttctccacgtggtcctctatctccggctgggccctttcttacagtttcctcttgtaaagattggcatgttgctaggcataaggttactgcaagcagcaacaaagtccgcgtatccacaaagctgagcatgtctagcacttagacatgcagactccttgtgtcgcagagcccctgggtcaccggcggaggtatcacctggcgggcgcgggcatgcagtcgtgg

SEQ ID NO: 382 - DNA, 528 bp, Homo sapiens
  misc_feature 18, 20: n = A,T,C or G
ctgagcagtttgtgggtntntcttcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtagcgccatcttggctcactgcacctccaccttccgggctcaagcgattctccagcctcagcctcctgagtagctaggactgcaggtgctccaccacgcccggctaatttttgtatttttagtagagatggggtttccccatgttgg

SEQ ID NO: 383 - DNA, 335 bp, Homo sapiens
  misc_feature 5, 321: n = A,T,C or G
ccatnttgagtctactcctgcgtcttgtgccctagcaccccgagaaccgtcagtttgagccagatggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcgaaaaaaaaaaaanaaaaaaaaaaaaaa

SEQ ID NO: 384 - DNA, 333 bp, Homo sapiens
agtccaatacggctattggggttgtagcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaagg

SEQ ID NO: 385 - DNA, 343 bp, Homo sapiens
ctgtgacacctcaggttgaaagggtcttcctccttgaacacccaccgaggggcctggagcaacagccagccgatatggacttctagctgcaccgggtcactgagggtggagaggtttgtctggcacctgtactctccactgtcgtcgactgtggcagcgtcaatgaagtagctcgaggcctggcttgagatgaggctctcattgtgaaaccactgtgtggaattgtcctcaggggagtaggctccctggcacttcagagtcacactgtccttctcgagcaccctgtaccattgaggctccaggaacaccacagcctttgggagatcttcagtccgcatgccaa

SEQ ID NO: 386 - DNA, 244 bp, Homo sapiens
tattctttgattcttggcaaataggtgagagaactaatagcaaccaggcaactgaggacgaagtcaaaaagtcggtaacagaagaatggaatcagccaacccacttgataagaaattgctccataaaccagcattgaactgattataaacataagaacagagacggcaaaaagaacacaggcattatcagccattctctcagacgaatagtaattaccgatgacttcatactgaatgttgacag

SEQ ID NO: 387 - DNA, 504 bp, Homo sapiens
atctggagtccagcctcagggatgcgctactttccattctctgcattgaacattcgttctgtcagcatccgctccagcttcactgcatcagcggcaaacttgcggatcccgtcagagagcttctccacagccatctggtcctcgttgtgcaaccaacggaaagacttctcatccaggtggattttttccaggtcactggcttgggccgccttggctgagagcacaggcaccagcttggcgttgtcctgcagcagctctcccaggagcttgggtgggatggtgaggaagtcacagccggccagtgctttgatctcgcccgtgttgcggaaggaggcgcccatgacaatggttttgtagctaaacttcttgtagtagttgtagattttagtgacactctttaccccagggtcttccaggggctcataggatttcttgtcggtgtttgccacatgccaatcaaggatgcgcccaacaaatggggagatgagggtcacacccgcctcg

SEQ ID NO: 388 - DNA, 450 bp, Homo sapiens
  misc_feature 14, 199, 210, 218, 231, 267, 271, 290, 330, 342, 383, 390,395, 399, 405, 414: n = A,T,C or G
gccaaagtgctgcntgaattccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttntttccaggtanagtagctntttgtacataaanaatacttgaaaaattaattgtatgatgtatgaaaanacanagtctcctagttttgtatnttgttgtatgactgccatgagttccaccaaaaagccactntattttggtctntgtgacattttaaatgcgtgacaaaagtgagcaaataaagngaggaanaaatntatntatganataatatanattgtattgaaatctaaaaaaaaaaaaaaaaaaaaa

SEQ ID NO: 389 - DNA, 297 bp, Homo sapiens
cctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggagg

SEQ ID NO: 390 - DNA, 223 bp, Homo sapiens
ctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccagg

SEQ ID NO: 391 - DNA, 365 bp, Homo sapiens
ctgaggaagaaatgaaaaaagaccctgtccctcatggcccgcccactggcctcctgtgaactctgtcctgttgccaaccccagatgaagtcagccaaaaagtgctttccacatcctctctctggggctgcccagcctgaccgtaggggatccactggcagagccaaggtggatgctggtgcctgaagctggaagccagcaggacatgagacccctcctgtagcaggaagtggttctagaactcccagcagaacagaacggaaaaggagctgattggggatagaatgagttctgctaaacagccagatgctctgagagaggtgacactggactgtctcggaggtgtgtgcagatggctacaggtgg

SEQ ID NO: 392 - DNA, 302 bp, Homo sapiens
  misc_feature 28: n = A,T,C or G
ccaagagctacaatgagcagcgcatcangacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacag

SEQ ID NO: 393 - DNA, 213 bp, Homo sapiens
  misc_feature 13, 19: n = A,T,C or G
ccaataatcaagnacaaanactggatttgaggatggatcagttctgaaacagtttctttctgaaacagagaaaatgtcccctgaagacagagcaaaatgctttggaaagaatgaggccatacaggcagcccatgatgccgtggcacaggaaggccaatgtcgggtagatgacaaggtgaatttccattttattctgtttaacaacgtggatgg

SEQ ID NO: 394 - DNA, 334 bp, Homo sapiens
cctacccataatccagagaggcttgcccagaggaggactacgtgggggacgtgccaccagaaccctacttgggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcag

SEQ ID NO: 395 - DNA, 174 bp, Homo sapiens
ccagatgaggaaaaaaattaggaaggagatgaagttttccaaatttcatggtatatgctgcacttccccaaccttcactctccatgtagcctactgggtctactattccacaaagtggctcaacctccaaatgacctctggtttacccctattaaaatcccaaaggactttcag

SEQ ID NO: 396 - DNA, 140 bp, Homo sapiens
  misc_feature 20: n = A,T,C or G
ctgcaaagccttgtgtaacnttctccagcatttggacccagtacgtgaaagcccacaacacgttcattgtctttagtattacagattatttttgcataacatttgttgttatctcttgacggaatcgtccattccaatgg

SEQ ID NO: 397 - DNA, 318 bp, Homo sapiens
cctcgcctggagggcccccgggcagcacagggaggacgagcttgtccagcagagggtctggcagagggtcccgcagaggtttgggcagggggtctgacatccctggctcctgctctggctctggctgccgggatttgcacaggcccaggtgcatacagatgccgtttgagtcagtctggttctggaagtagtcgatgaccagggggaagtagtcgtcaagcacttggttgcactggggcatgagcagcttcaaggggaggacgttgcactcctgctccaggaacttcctcatcgtgtcctggaaaatggcctccttgg

SEQ ID NO: 398 - DNA, 517 bp, Homo sapiens
  misc_feature 5: n = A,T,C or G
ccttncttcgccatccattcatcgaccctctccagcacttgctgcaggcttggctgaccatccaccatggcttgaataatcccggtgagctctgtacagaatggggtaagctgtggatggactacaggctggacatacatgtgaaaggtagactcaatctccatggtccggccatttagctttaggatggggaactcgatgatttcctgaggatgaatctgtggcttgtcgcacgtggcctcaaagtccagcactaaaaagtagtgatacctctggagagggaaggacaccattgccgccatggatgcgccaaagccgtgggccgccagctttctggtggatatggagcagaactccggaacaccacagggagaaaataagtgggagcccagcacttttcttgctcttgaaagtaaatacgaagaaaatcgagctgctccagtctgtaaaggtgctagcattgaacatccagaagcatctaaaactctccttacttcgaagatgccaagaccggcag

SEQ ID NO: 399 - DNA, 329 bp, Homo sapiens
ccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttccttttttcggtaacaagacttagaaggagggcccaggcactttctgtttgaacccctgtcatgatcacagtgtcagagacgcg

SEQ ID NO: 400 - DNA, 451 bp, Homo sapiens
ctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaagctgctggagctggcaaggtcaccaagtctgcccagaaagctcagaagctaaatgaatattatccctaatacctgccaccccactcttaatcagtggtggaagaacggctcagaactgtttgtttcaattgg

SEQ ID NO: 401 - DNA, 180 bp, Homo sapiens
ccaggaagcaggccaggggattggcagcactgcccagcaccacagccaggtggtaggccagacgcccgtagggtaagcaggaaaagctctgcacggcaggcagcacgccattggtcagcgcgttggtggcggccaacaggcccagcaggcaggcactgcgggctgatagaagctgatagg

SEQ ID NO: 402 - DNA, 385 bp, Homo sapiens
ccaggccacctgtgcggggctcctcgatgtggaaggttcgggtgaggagattgtagaaggagccgtagcacacggccaccacagtgcacgtgaggcagatcacgttgtagggcatgctgaagtccggtgtcggcaggttcaccagcagcggctccgtgtagagccgcacaaagtagttagagccatcagagactgggaacaggctgttgaagaggggactctcttcccagtccactggcttggctgctaccatgctgggcacaagggcgctgaggacagatgggctgacatagaagccatggttaggatctggcgtgtactcggtccacttcagcagcgcccgctcaaactggatggaaaccttggtgactgagttggccggcag

SEQ ID NO: 403 - DNA, 440 bp, Homo sapiens
  misc_feature 13: n = A,T,C or G
ctgtttaaccagnaacccggggggtcaccccccacagaatgtacatgaaacactagaggactgcatgtttttccctgagagaagcgtaagacaaacagaagtcaaaaagtagtcactgggagcgccatccttctaagcaaatcctccctttcccttttggaggatttgcccgaactacgtagccagtcagcacttagaccacctgcctcctcccccccctataaacccaccactcccctcctcctttcccaaaccacttggggtgtcctaagccctcactgccccaagcccaaaatatcagctaagatccttgtcagtatttccacagtcatacctaatgaattgggaagtggggcccctaaaaaccaattcacatctatgcacttgtttccactggatttggcagacaggcttttttagttaccgtaaccagatcttaa

SEQ ID NO: 404 - DNA, 239 bp, Homo sapiens
cctacgaaaaactcccggccggtgaagagaacgtcagtgccatccagcgtcgcgttctcgtctcctatttccacaattcggagccccaggtcttgcagggctttgcggactccatcgacctctggcctacgagcggggctccagggccgcgtgattagggccgtgtccccttggatcacggccgtgtcgccaagcagcggtcccagcggcaatgactcctcaggtggcagttctagcag

SEQ ID NO: 405 - DNA, 261 bp, Homo sapiens
ctggagaggcagcccttcaccggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcag

SEQ ID NO: 406 - DNA, 641 bp, Homo sapiens
  misc_feature 13: n = A,T,C or G
ctgctcccgggcntggtggcagcaagtagacatcgggcctgtgcagggccacccccttgggccgggagatggtctgcttcagtggcgagggcaggtctgtgtgggtcacggtgcacgtgaacctctccccggaattccagtcatcctcgcagatgctggcctcacccacggcgctgaaagtggcattggggtggctctcggagatgttggtgtgggttttcacagcttcgccattctggcgggtccaggagatggtcacgctgtcataggtggtcaggtctgtgaccaggcaggtcaacttggtggacttggtgaggaagatgctggcaaaggatggggggatggcgaagacccggatggctgtgtcttgatcggggacacacatggaggacgcattctgctggaaggtcaggcccctgtgatccacgcggcaggtgaacatgctctggctgagccagtcgctctctttgatggtcagtgtgctggtcaccttgtaggtcgtgggcccagactctttggcctcagcctgcacctggtccgtggtgacgccagaccccacctgcttcccctcgcgcagccaggacacctgaatctgccggggactgaaacccgtggcctggcagatgagcttggacttgcgg

SEQ ID NO: 407 - DNA, 173 bp, Homo sapiens
ccaggtactggcacaatcatgtctggatgggggtggtggtgtcctgtaggcagagaaacaggaaattgtcgtagtcagtatcgagcagcgtggcctcgttcgccaccgtatagttgatcttgaacttctttggattctcagtcttctctccaaggaccttcttctcaacacag

SEQ ID NO: 408 - DNA, 165 bp, Homo sapiens
ccactgtctgcagccatggcagaaagtgctcaaagtccagcaccttcacattcatctcatcactcttggggttccccaggaccttgagcacctcggcgttggtagggttctggcccagggccctcatcacatccccacactggctgtacaggatcttgccatcac

SEQ ID NO: 409 - DNA, 329 bp, Homo sapiens
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacctatgagacacaccagtgtggccttgttggcttgaagctcctcagaggagggcgggaacagagtgaccgagggggcagccttgggctgaccaaggacggtcagcttggtccctccgccaaataccgccggataagcaccactgttgtctgctgattgacagaa

SEQ ID NO: 410 - DNA, 235 bp, Homo sapiens
  misc_feature 8: n = A,T,C or G
ccatcagngagaaaggtgtttgtcagttgtttcacaaaccagattgaggaggacaaactgctctgccaatttctggatttctttattttcagcaaacactttctttaaagcttgactgtgtgggcactcatccaagtgatgaataatcatcaagggtttgttgcttgtcttggatttatatagagctttttcatatgtctgagtccagatgagttggtcaccccaacctctggag

SEQ ID NO: 411 - DNA, 294 bp, Homo sapiens
aattaagggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcctgaagaagaacctgaagagacagcagaagacacaacagaagacacagagcaagacgaagatgaagaaatggatgtgggaacagatgaagaagaagaaacagcaaaggaatctacag

SEQ ID NO: 412 - DNA, 433 bp, Homo sapiens
  misc_feature 135, 138, 153, 162, 187, 206, 208, 212, 214, 219, 224, 237,254, 271, 295, 303, 330, 336, 348, 358, 364, 367, 375, 394,433: n = A,T,C or G
cctgagaagccagaggcaggtggagagggggtggaaagtgagcagcgggctgggctggagccgcacacgctctcctcccatgttaaatagcacctttagaaaaattcacaagtccccatccacaaaaaaaaaaanaanaaaaatttcagggantaaaaatanactttgaacaaaaaggaacatttgntggcctgggggggcatctnantttntntagcnccagngattccctccccnccccacccatcacatanatgtaacacctttggtntaaaatggggagccgtttccaccntgcccccntccccgcccccaggcagttgccccggngacacntcaagacaggancgaggtagtntttcancancacagttncacaaggaacagaacagtntctcccgcccagccctgcggcacaagggattgacacgcn

SEQ ID NO: 413 - DNA, 494 bp, Homo sapiens
  misc_feature 17: n = A,T,C or G
ccttatttctcttgtcncttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgttatgcccgcctcttcacgggcaggtcaatttcactggttaaaagtaagagacag

SEQ ID NO: 414 - DNA, 294 bp, Homo sapiens
ctgggcggatagcaccgggcatattttggaatggatgaggtctggcaccctgagcagtccagcgaggacttggtcttagttgagcaatttggctaggaggatagtatgcagcacggttctgagtctgtgggatagctgccatgaagtaacctgaaggaggtgctggctggtaggggttgattacagggttgggaacagctcgtacacctgccattctctgcatatactggttagtgaggtgagcctggcgctcttctttgcgctgagctaaagctacatacaatggccttgtgg

SEQ ID NO: 415 - DNA, 421 bp, Homo sapiens
ccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacag

SEQ ID NO: 416 - DNA, 342 bp, Homo sapiens
  misc_feature 17: n = A,T,C or G
ccactttctttcccacnctggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcactcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccgg

SEQ ID NO: 417 - DNA, 389 bp, Homo sapiens
tattaattaggttcttaagacatttagaacaccaatttgtgaggataaattccattcgtcagagcaaacacagatcgcaggtagccctggagctgaggaatagctttgatttttggtaaaatttgtgagtccacagctttctgatcaatcttgcgctgctccgtaatctcatatttctctttttctgtgtcgaagatctcaccttcctggtgtctgggcttccgcagcttcttcttcttgaagtaagcatcagtaagatgttttgggatttttacattgctgatatcgattttggttgaagtggcaatgacaaatttctggtgtgttcttcgtagaggaactcgattgaggaccagaggtccagtcacaagtaataagccactagccag

SEQ ID NO: 418 - DNA, 343 bp, Homo sapiens
gtgggagggagccaggttgggatggagggagtttacaggaagcagacagggccaacgtcgaagccgaattcctggtctggggcaccaacgtccaagggggccacatcgatgatgggcaggcgggaggtcttggtggttttgtattcaatcactgtcttgccccaggctccggtgtgactcgtgcagccatcgacagtgacgctgtaggtgaagcggctgttgccctcggcgcggatctcgatctcgttggagccctggaggagcagggccttcttgaggttgccagtctgctggtccatgtaggccacgctgtttttgcagtggtaggtgatgttctgggagg

SEQ ID NO: 419 - DNA, 255 bp, Homo sapiens
cctagcaagagaatcaccaaatttatggagagttaacaggggtttaacaggaaggaagtgcctttagtaagttctcaagccagaggctggaggcagcagctaaatcagaggacagcatcctcagtgaaagtgagccattcggggtggcatgtcactccaggaataaacacaacttagaaacaaatgatttcgtaggatagcacagtgacatggtgcactgtgaacctgaggccactgtgtcaaactgtgcactgg

SEQ ID NO: 420 - DNA, 261 bp, Homo sapiens
cttctgatgataaccaacccctagctaccactctgtattcatcaggggaggggtataaaccccacatgcaagaagaacccttgcccccagtgtcaaatgggatggggatgctagagttatagtaaaggggaaaccctatgtaagctgttaacagagttcacaggggtagggataacccctgttctccagctcccaaatgtgctcactttcccagcttcttcatccgttcatcaatgctggcaaagttcccctcaactgtgg

SEQ ID NO: 421 - DNA, 179 bp, Homo sapiens
ccttcctgttgttgtttcaaatgctgcttgatttctcgtaacagatctgcatctatgtaatacctttcttcagatctgactgctccaaaatgattctgcatcctgatttgagacatcaattcatttagtcggcccttgaactgagtaggtgcatttagttcaccctgaatcgtatccag

SEQ ID NO: 422 - DNA, 424 bp, Homo sapiens
cgaggtccaaatctgatctgcagatgcagaagattcgacagaagctgcagactaaacaggctgccatggagaggtctggaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcacaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagagg

SEQ ID NO: 423 - DNA, 256 bp, Homo sapiens
ctgtggcctagggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcg

SEQ ID NO: 424 - DNA, 330 bp, Homo sapiens
ccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcag

SEQ ID NO: 425 - DNA, 333 bp, Homo sapiens
  misc_feature 12, 124, 133, 145, 152, 244, 249, 254, 263, 307: n = A,T,C or G
ctgctccatggnctcaaagtcagcaccacccacacccacaatgatcactgacatgggcaggttcgaggcacgcaccacagcctcacgtgtggcttccacatccgtcacagcaccatcagtcagnagaaacagnatgaagtattgngaggcantcccctgatgtgcagcctgggctgcaaacctggacctgcccgggcggccgctcgaaagggcgaattccagcacactggcggccgttactagnggatncaganctcggtacnaagcttggcagtaatcatggtcatagctgtttcctgtgagcggntgggatgaacgcggccgtacgctcat

SEQ ID NO: 426 - DNA, 411 bp, Homo sapiens
  misc_feature 346: n = A,T,C or G
gggtgttcatcatgaggattgcttctgccatggagctgatggacgtgggcaggttgctgagaaggtggggtggaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggtgtaaaagatgaggcagtanaaatgcctttgaatggttttctgtagctaattctctttaaattttgtcctgctttttttctttat

SEQ ID NO: 427 - DNA, 450 bp, Homo sapiens
  misc_feature 136: n = A,T,C or G
acgtgtacaagtttgaactggatacctctgaaagaaagattgaatttgactctgcctctggcacctacactctctacttaatcattggagatgccactttgaagaacccaatcctctggaatgtggctgatgtggncatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctgg

SEQ ID NO: 428 - DNA, 377 bp, Homo sapiens
  misc_feature 133, 181, 246, 264, 280, 290, 300, 325, 360, 362, 374: n = A,T,C or G
cagggctatagtgcgctatgttgatctggtgttcatgctaagttccgcatcaatatggtgacttcttgggagtgggggaccaccaggttgcctaaggaggggtgaacctgcctacgttggaaatagagctggncaaaactcctgtgctcatcagtagtagaattgcacctgtgaatagccnccgccctccagcatgggcaacataacaagaccctgcctcttaaagataaaaattggaaaacactngtaggaaaaaaagggtgnttggtctaaataaatntggattgggnataaatgacncaaaactatcatgaatttgaaagcntttctaatttcttgaaagtctgaaaaaagttaaancncaattttatctnaaa

SEQ ID NO: 429 - DNA, 206 bp, Homo sapiens
gttgctcctccaaagaaggttggcttcaaggccgtgtccagggacccacgagcagaggcactggggggcaagggatctccaagggggcaagggatccctaaagggggtagctcacaggtgagggggtttagggcccctctagggagcgcctgaggccatacattcaagagtgtccctggtgaggcccagggaagagccaggactgg

SEQ ID NO: 430 - DNA, 473 bp, Homo sapiens
  misc_feature 9, 329, 335, 363, 365, 448: n = A,T,C or G
ccttatttntcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcnccccanccgaaatttttaatgcaggtttggtagntnaggacctgtgggtttgttaggtactgggtgcattaataaattaaagctccatagggtcttctcgtcttgctgtgttatgcccncctcttcacgggcaggtcaatttca

SEQ ID NO: 431 - DNA, 215 bp, Homo sapiens
  misc_feature 8, 15: n = A,T,C or G
cctgtatnaagctanaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcagg

SEQ ID NO: 432 - DNA, 391 bp, Homo sapiens
  misc_feature 377: n = A,T,C or G
ccagcactgccacaaactttttcagggccaccaggcgctgcccttccaggaccgggaacctgcccacttctatccgcaggatgtagtgcagtgcagattccaggtcagccatgtagatcctggagcgatctgccaatttccaaacagtgggagctatcttgttagcagtggttggtgcaactgtggtctgggcagcctccctggtgagcccagagagtctctgcaggtaagcggtatagaaggacctggattccatgagcacggggactcgggagacggagccattccggaacagcaggtagcaagaggggaagtcggtgacaccaaactttctcaccacattggcctctgtgttcagcaccctgcgcaccgccacncctttgtgctggga

SEQ ID NO: 433 - DNA, 420 bp, Homo sapiens
  misc_feature 275, 295, 328, 374, 399, 413, 420: n = A,T,C or G
ctgtagcttctgtgggacttccactgctcaggcgtcaggctcagatagctgctggctgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacgtaggacggttagtttggnccctccgccgaatgccgcanttctactgtcccacacctgacagtaatagtcancctcatcttcggcttgggctctgctgatggtcagggtggcccgtgntccccgagttggagccagggaatcnctcagggatcccanagggccn

SEQ ID NO: 434 - DNA, 239 bp, Homo sapiens
  misc_feature 8, 199, 236: n = A,T,C or G
ccaaccangagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggnccccctggaccccagggtcttcctggtctggctggtncag

SEQ ID NO: 435 - DNA, 415 bp, Homo sapiens
  misc_feature 78, 225, 228, 276, 328, 330, 339, 352, 378, 387, 405, 415: n = A,T,C or G
ctgtccaatggcaacaggaccctcactctattcaatgtcacaagaaatgacgcaagagcctatgtatgtggaatccanaactcagtgagtgcaaaccgcagtgacccagtcaccctggatgtcctctatgggccggacacccccatcatttcccccccagactcgtcttacctttcgggagcaaacctcaacctctcctgccactcggcctctaacccatccccncantattcttggcgtatcaatgggataccgcagcaacacacacaagttctntttatcgccaaaatcacgccaaataataacgggacctatgcctgtttagggntntaacttggntactggccgcaanaattccatagtcaagagcatcacagnctctgcatntggaacttctcctggctntcagacctgn

SEQ ID NO: 436 - DNA, 152 bp, Homo sapiens
ccaggattgacaggccatccattcacagccaggagatgctgggccagtccctccaagaggtctccgtcatggcagtgatgaaaacctaacagggtggccccctgtgccagctcaggtgactggagcccgagggcctgacaggttcccagcag

SEQ ID NO: 437 - DNA, 174 bp, Homo sapiens
ccaggtactggcacatcatgctctggatgggggtggtggtgtcctgtaagcagagaaacaggaaattgtcgtagtcagtatcgagcagctgtggcctcgttcgccaccgtatagttgatcttgaacttctttggattctcagtcttctctccaaggaccttcttctcaacacag

SEQ ID NO: 438 - DNA, 485 bp, Homo sapiens
  misc_feature 324, 371, 393, 412, 419: n = A,T,C or G
ccacggccctctcggccctctcgctgggagcggagcagcgaacagaatccatcattcaccgggctctctactatgacttgatcagcagcccagacatccatggtacctataaggagctccttgacacggtcaccgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccnggtccacaaaggaaattcccgatgagatcagcattctccttctcggngtggcgcacttcaaggggcagngggtaacaaagtttgactncagaaangacttccctcgaggatttctacttggatgaagagaggaccgtgagggtccccatgatgtcggaccc

SEQ ID NO: 439 - DNA, 317 bp, Homo sapiens
  misc_feature 146, 268: n = A,T,C or G
gggccgtcttcccctccatcgtggggcgccccaggcaccagggcagtgatggtgggcatgggtcagaaggattcctatgtgggcgacgaggcccagagcaagagaggcatcctcaccctgaagtaccccatcgagcacggcatcgncaccaactgggacgacatggagaaaatctggcaccacaccttctacaatgagctgcgtgtggctcccgaggagcaccccgtgctgctgaccgaggcccccctgaaccccaaggccaaccgcnagaagatgacccagatcatgtttgagaccttcagcaccccagccatgta

SEQ ID NO: 440 - DNA, 338 bp, Homo sapiens
  misc_feature 4: n = A,T,C or G
ccanaaagacttcccagggaagatgcttggctctctgctccaaggtgggccatggtatagggccctcgaagggcttgtggctggggtgatcccagggggcattgctcaaagtgcacaggaggtggcagcagggtcaggcgagttcctgttccagggacatcaggagggagggtagaagcctagggagtgtgcgaggctgctgggatgagggagctcaggggctaccagctaaccagcctcagctcaatggtttctccatccttgggtctgtagtcagcaataccttgcaacagtggggtgttggggtctcggagaagctgccagaactccctttctcc

SEQ ID NO: 441 - DNA, 505 bp, Homo sapiens
  misc_feature 10, 186, 246, 321, 330, 403, 404, 406, 416, 445, 459, 481,484: n = A,T,C or G
ccacacagantcaccaagccacagacttgtcttccacaagcacgttcttatcttagccacgaagtgaccaagccacacgtactaaaggttgaactcaaagatatgtacagggtattaaacaaataccaaggggaacagttaacttcaatacaaggtcgaaatcagcaacaagttctacaatccagngctgatatcagatacaagcttcaaggacaatttcttttcgaaggcttattccagtttcgngaggctagcatgaggtgtgtgcatttgccaggggcaaatttctattctcaattaacccatgcagcaaatgctacncatggtgcngagtccgtttagaagcatttgcggtggacgatggaggggcccgactcgtcttactcctgcttgctaatccacnngngctggaaggnggacagtgaggccacggatggagccaccnatccacaccgagtncttgcgctctgggggtgcgatnatnttgatcttcatggtgctgggc

SEQ ID NO: 442 - DNA, 386 bp, Homo sapiens
  misc_feature 331, 369: n = A,T,C or G
cgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaaccgtaagaaagggcccagccggagatagaggaccacgtggagaaaggggtccaccaggccccccaggcagagatggtgaagatggtcccacaggccctcctggtccacctggtcctcctggcccccctggtctcgatgggaactttgctgctcagtatgatggaaaaggagggnggacttggccctggaccaatgggcttaatgggacctanaggcccacctggtgcag

SEQ ID NO: 443 - DNA, 404 bp, Homo sapiens
  misc_feature 241, 306, 311, 328, 339, 362, 372, 385: n = A,T,C or G
cctccctctcagagcttgccccagggactctctggccctcagggttcaatgtattctgaccaaggccaagctttcctggggctcagggaaaatcacactttgctacccgaagctgtatcccctcagatgccaggaaggccgtgatcatctgactccaccctcctgagacacattctctccctgactgtcctgttctaagtcagcggagcaccttaggatggaggggtggaggcgaggccangatgcagcctctgtgaacaggtgcctggaggctgggaaatgaccctgagagggcaggacacagcnaccgngggcttaaggtgagggnggagagcaagnttggcccactttacaattctagntcagagccancccctaacatggngggcatttattcatttcgg

SEQ ID NO: 444 - DNA, 318 bp, Homo sapiens
  misc_feature 58, 69, 87, 195, 250, 275, 286, 302, 305, 317: n = A,T,C or G
catgggctatagtgcgctatgttgatctggtgttcatgctaagttccgcatcaatatngcgacttcttnggagtgggggaccaccangttgcctaaggaggggtgaacctgcctacgttggaaatagagctggtcaaaactcctgtgctcatcagtagtagaattgcacctgtgaatagccaccgccctccagcntgggcaacatagcaagaccctgcctcttaagataaaaattggaaaacactggtangaaaaaaaggctgtttggtctaaanaagtctggatngggtataaatgacacnaanctatcatgactnt

SEQ ID NO: 445 - DNA, 418 bp, Homo sapiens
  misc_feature 288, 354, 375, 387, 389, 400: n = A,T,C or G
ccagtccaacctgctcctcattattgtataaatgagcagaatcaatatggcggaagccagcttcaattgccaatttggtggcctctaaagctttacttttaggaacctctgcaggcgcataggtgccaaatcccaggacaggcatgaagtgaccatcattcagcttcacacactgatatttcgaatccatttctgtcactagcctggctggcaaatgtttctttcttcctccctcacaggctataagagcaatgagctggcaacgcccctgagcacactgtctgctgnttaaccaatggcatgtgagaggagggacagaggcagtcttacacaagctgtgataaaaattgcatncagttcaaccagtttcttacnttattctaatgngnaggaagtgtgngaagagcacaaagtcaga

SEQ ID NO: 446 - DNA, 361 bp, Homo sapiens
  misc_feature 10, 78, 89, 148, 193, 201, 253, 259, 265, 288, 290, 292,298, 318, 342, 343, 346, 354: n = A,T,C or G
ctgtccaatnacaacaggaccctcactctactcagtgtcacaaggaatgatgtaggaccctatgagtgtggaatccanaacgaattaantgttgaccacagcgacccagtcatcctgaatgtcctctatggcccagacgaccccaccntttccccctcatacacctattaccgtccaggggtgaacctcagcntctcctgncatgcagcctctaacccacctgcacagtatccttggctgattgatgggaacntccagnaacacnacacaagagctctttatctccancntnactganaagaacagcgcgactctatnccttccagggggggggggtggggnntgnggaccttnccgggcc

SEQ ID NO: 447 - DNA, 321 bp, Homo sapiens
  misc_feature 7, 9, 105, 121, 192, 202, 213, 299, 301, 305: n = A,T,C or G
ccagganantggttccccaaaggggacctcacccgccccgagctctggagccgctgacgctcgcatccaggacatttgagatgggaatccaaataggctacttgnaaaagacgtgctgcangcagccctggagagactcatggagttcattgtacattactccatctaccgaggcagcgcatggcatgactnaacggcttgnaacaaacacanaaattaccaccacaaacattcaggaaccaaatataatctgctatggtcacaccacagacaatgcaggaagaggctttttattgctngngtgngttttcaaatcatgtt

SEQ ID NO: 448 - DNA, 325 bp, Homo sapiens
  misc_feature 107, 222, 251, 296, 301, 325: n = A,T,C or G
ccagcttcaactttttagtatagaagatacaggatcacaaaaaggagactacgctttgcaaacatagcatcaaaattcaacttttctctttgcagtttatccatggngtcagcataccttgcaagggaagctacttacatcaaataacttttctatatacatttcctcattgaccttttctcaaagaatatcttggttttgccgaacaaacataatataggngtctgccagatccattcctggtttctgtngtgaaggaaaagcagggggaacaaaataatatcagggtctcaatngtganattattatttaatcataccctgan

SEQ ID NO: 449 - DNA, 123 bp, Homo sapiens
  misc_feature 8, 69, 70: n = A,T,C or G
cattaatnttggaagcgatggtgtggattacatcagtgttagggcatggtgtggatattattacattannattggaagcgatggtgtggattacatcagtgatagggcacggtgtggatatta

SEQ ID NO: 450 - DNA, 328 bp, Homo sapiens
  misc_feature 241, 257, 323, 325, 328: n = A,T,C or G
ctggcaattttgagctgccggttatacaccaaaatgttctgttcagtacctagctctgctcttttatattgctttaaatttttaaagaaattatattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatngggatgtttttgtaangttaattttctaagactttttcacatccaaagtgatgctttgctttgggttttaactgtttcaacntnggn

SEQ ID NO: 451 - DNA, 209 bp, Homo sapiens
ctgccttgtttcaacagacatgcaaagatcctaggagacagtccccatagaccttcagacattaaaaagggagccgtacagtttgtttgaagcacttcgtcttacccatttatgcaggggccccaggaaacttacacacagccagaatgaggttcccaaaggacttacattaattatggctcttgcttcctttcacaaatgagctgagg

SEQ ID NO: 452 - DNA, 457 bp, Homo sapiens
  misc_feature 8, 290, 392, 416: n = A,T,C or G
ctgtctantcccttcaagagctgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgnatatggctgtttaatctttgaagcattttgggcttaagattgccagcaccacacatcagatgcagtcattgttgctatcagtgtggaatctgatagagtctngactccggccacttggagttgtgnactccaaagctaaggacagtgatgaggaagatggcatgtgg

SEQ ID NO: 453 - DNA, 277 bp, Homo sapiens
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactacgagggcgtgatcatgaaaggtgataagctcttctatgataggggaagtagcgtcttgta

SEQ ID NO: 454 - DNA, 198 bp, Homo sapiens
gttaaaagatagtagggggatgatgctaataatcaggctgtgggtggttgtgttgattcaaattatgtgttttttggagagtcatgtcagtggtagtaatataattgttgggacgattagttttagcattggagtaggtttaggttatgtacgtagtctaggccatatgtgttggagattgagactagtagggctagg

SEQ ID NO: 455 - DNA, 608 bp, Homo sapiens
  misc_feature 43, 225, 502, 508, 569: n = A,T,C or G
ctgagcaagctaaggaccaggggcaactagaccctaataatgngtacttttgaaaatgatacaaactaccttggttgtaagaagtgcaggttgaacactttaggagaacagtcttcaaactggcaattcaaaatttcccattatatgtgaataaaattggaaggatgttaaatgtccatggaaagttactcttgtaagttaggatgccttatactgaggctttanaatgaaagtacacttcacaaatggaatagtgaacataaattaccagaagtcaagataatagtcatactagtaaggtaagcaaggtaaattcccttatacacaaaaattattttgatgacctttttcaataatgaatctgaaatgaagtgttttaaaaagctccctaaacacaaaacgaacataaaactgcttaataactttagagctcatgtaatattcttgctgaaaacagttactgaaattaccagcgaaatgatggaatatctttaaagcaggncactcngtataatctggaataatttcatttgctaacttttaagaagtattctctggactataaatcntgggcaaatagacttccactttattattaccccaaatta

SEQ ID NO: 456 - DNA, 467 bp, Homo sapiens
  misc_feature 358: n = A,T,C or G
cctggacctgtgtaaaccttcaaacactcttttttacattaggtcgtgaagttaaattttttactgtttctgtgctacagactcttcaaagggaaatagttaagtcaatttcaaagaaaatgaccagcacatttttaaaacattagaaatgatttgactttgactatctactgccaaaaaaaggttaaggaatttgtaatgagaagctaaaaactttaaggaattttaaggaactcaaaacaaaaactcattaaatgtaattaaagtgaattctacaaataaagcctcttaatacatttctataatagtcacttaagacttaaattcaaacactagcaaaccacaaaatcagactgtntgactgacatccaaaagataaatataaatcaaaatccgaccccagcattagccaaggggtaggtgttcctcttgaggaaggcaggaattcctcttctgccacctgttgg

SEQ ID NO: 457 - DNA, 183 bp, Homo sapiens
  misc_feature 10: n = A,T,C or G
ccaaattttntactttaaacactgaaaacagaggaagttaataaaaattttaacctataaagtcccctggttgttagtcattaacagcagattgtcagataagactggtaaaatgatggctgctaagcatttgatgatccaggcgcaggatgatcaaactgcagcagatcatgcacgtgacag

SEQ ID NO: 458 - DNA, 445 bp, Homo sapiens
  misc_feature 324, 372, 388, 396, 431: n = A,T,C or G
gaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggtttttggaagagttagaagaatttggaaggccttaaatatagtagcttagtttgaaaaatgngaaggactttcgtaacggaagtaattcaagatcaagagtaattaccancttaatgtttttggcnttggactntgagttaagattattttttaaatcctgaggactancattaatgggacag

SEQ ID NO: 459 - DNA, 426 bp, Homo sapiens
  misc_feature 10, 345, 363, 400, 401: n = A,T,C or G
cctatgatancttctctagctatcatactccaatcagcaaaaaatgagaaaatgttgagaaatagaagataattcctcatttaaggccaccttctagaatttgtgcttaagattctgctttcttctcatgggccagcacttcggcaactggcaaaaattaggtgtacagggatctaggtaatactgtttatttgagcaataatatattgtgctaacgttcaggcatcctattactgagaaataagggaaaatgagtgtaaagtacaactaagagtctcggcgacagggaaaaataccatcagttaaatatccatagtcctagagcatttatgtaaaactgcaatntgaatcctgcaatacatnttggctttttccctcagtgataccatgtgagggaagnngctctgtcaaggcgggccggataga

SEQ ID NO: 460 - DNA, 348 bp, Homo sapiens
  misc_feature 147, 184, 203, 288, 294, 308, 312, 313, 316, 333, 345, 347: n = A,T,C or G
ccaaattttaaaatgttatttttcatatcatttataaccttgtcacaatccacttaaagaagtttggttatatttcactgaaaattttcttccagagtaggttttttttcgtgggttggggggtaactttactacaattagtaagtntggtgcagaatttcatgcaaatgaggagtgcagcagngtgataatttaaacatatntaaacaaaaacaaaaaaaatgaatgcacaaacttgctgctgcttagatcactgcagcttctaggacccggtttcttttactgatntaaaancaaaacaaaaaaantaannacnttgtgcctgaaatgaancttgtttttttntna

SEQ ID NO: 461 - DNA, 378 bp, Homo sapiens
  misc_feature 370: n = A,T,C or G
ccactaagacagaacggaatctagtagaagtgcaccaatgcttcagtccctcctactcagcatggtgagcagtggtcaatctgtgccctgtggaatgatgggcagataattctggcatgtgtaaataataataaataattcacttggtgcaggcagtatgtctatgaattaaaacctagtgtgtacacagtgcctacatgtgttacagccccacagtaggaatctacaccaaaatatttattagaaggaatttggtccgtactacatcacgctttccggagggtaaaaaataaagtccatctatagacatttcaccacagacccagagactgagtctggctaaaacctgcaaaatgtctataacaaaagnggatggct

SEQ ID NO: 462 - DNA, 197 bp, Homo sapiens
  misc_feature 59, 72, 81, 99, 105, 112, 120, 137, 140, 155, 158, 163, 182,190: n = A,T,C or G
gcgaggtccacactattaaaagctgttgggtaattgaaggtgatataaaatgactgtcntcatttggagtgngcagcacanttacttcatgttgctcangtttanaacaatntcccctgnaagttctcacacagatnggnagaaatcatacctanttntggtnaatcactatggcagccgtngaagaatntaagaga

SEQ ID NO: 463 - DNA, 279 bp, Homo sapiens
  misc_feature 13, 18, 26, 28, 43, 164, 175, 200, 201, 203, 219, 222, 230,246, 262, 263, 267: n = A,T,C or G
cataagtgatgangaggnaaaatcantnaataagcctacaacntagaatacattaaaacttgcacatatacatgttcacagcatgtatacaatgataatccctacggtttaaccaagttatggttcccttctacagcagacacaaaaccaaggtgaactaggtnggcagatgtanagggaataccaaaaaaagggtaatnngntcactgattctgaagnatntgactgancatactgagcttctgnactttgggaatgcatnnaggnaacaatatcttg

SEQ ID NO: 464 - DNA, 552 bp, Homo sapiens
  misc_feature 266, 287, 395, 444, 460, 481, 487, 493, 512, 520, 532, 549: n = A,T,C or G
gatgggttgataggtgcagcaaaccaccctggcgcatgtttaccaatgtaacaaacctgcacatcctgcacaggtactccaaaactaaaagtaaaaaaatctaaaagaaaaaagaaaaagaattaaacccaaaatcacttccccatctggacttgatttagatgaaaagcttctggactttgagctgatgctatagtgggttgaaaattttggggtcctcagaaggggatgaggatatattgcatgagagagcaacatgaatcatngagagccagagtatagagagnggtgggtagactgtaggagagccctcaatgatcccggctgtcttgtattcgcgttgcacttacttgtataatatggcagatgggatgtgatgtcactttcaagattangttataaatagactatggcttcaatcagagggttttcttctctgtctanctctcttttgggtagnttcattctgagagaaagccanacctcngccgcnacccacgctaaggggcganttccagcncactggcggccngttactagtggatccgngct

SEQ ID NO: 465 - DNA, 444 bp, Homo sapiens
  misc_feature 124, 326, 360, 369, 388, 394, 399, 413, 415, 438, 443: n = A,T,C or G
ccactcttggtagaaaccttgaaactttcaccttgctgggctttagcaaagtttccttttacagttctgtttatgagcttcagctactgataaagcacttcctgaacttctctattatcatagngaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgcttttttgagacagagaagaaattcaggaggtgncccatctccagagtttctctgttggaaagcagcnatcaagaancctttaaaaaattggtgtnaagctntgccncctgcagaaatgcntngccccacattattcttctggggnaaagna

SEQ ID NO: 466 - DNA, 381 bp, Homo sapiens
  misc_feature 265, 325, 326, 338: n = A,T,C or G
cctactatgggtgttaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggnttcgggggtcttagctttggctctccttgcaaagttatttctagttaattcattatgcannaggtataggggntagtccttgctatattatgcttggttataatttttcatctttc

SEQ ID NO: 467 - DNA, 95 bp, Homo sapiens
  misc_feature 7, 11, 15, 46, 69, 74, 77: n = A,T,C or G
cctatanattntggnttgtatactgggtcctgaaaaccctcttggngctctgtttttaaggagctgaanccaangancgccaataataatacttt

SEQ ID NO: 468 - DNA, 224 bp, Homo sapiens
cagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccagg

SEQ ID NO: 469 - DNA, 416 bp, Homo sapiens
ctgagttctagttcaaaagctttatccttaacttcgtcatgtactatgtaaattctagaatagaaaagggaaaggtaagattttggtaacctccaaacattgaagtagttcacagacccaaagtcagtacaaattagaatgtccatccataataaaagtatctataaaattacacagacacattctacatagtatttaacattagagaagacaaattacacagggactgaaataaaatgaaacatctactctcccgacaaatgttgaatatacctaatcaacccaagttcagtttatttttgcacattgctttagagatataacttggctgggcacagtggctcacacctgtaatcccaacactttgggagaccaaggcggatggatcacttgaggtcagttcgagactagcctgg

SEQ ID NO: 470 - DNA, 376 bp, Homo sapiens
caccttttaactgtatcacaaagtctgttgctgtggttacagcctttgtttccagtgatgttttgtccatgctttcccccaacccttaacaatggttactcaaaagaatgaaataatgagtcattcattcgggaatatgttaaaatatccctctttatcattacatttcactgcttagaaactaggctgtaattcaaggcaacagttaagtctgagaactgttaaaaaaatctttgattttttttcatttttaagaaaaacctgcctatttaattgttcagacttgtaagaggttcttcaattacatcctttttggttaatgtattatttctggaacaagtagataaaattctacgcagtaagcataataaaaatc

SEQ ID NO: 471 - DNA, 357 bp, Homo sapiens
ggcttcgtataatggttcttttgtcacccctgatcgacgatttcgctacccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttaccgtgctggtgctcgagttagaaatattgaagatggtggccgctacagggatatttcag

SEQ ID NO: 472 - DNA, 557 bp, Homo sapiens
  misc_feature 2, 29, 213, 428, 515: n = A,T,C or G
cngagatgacatttacaatctcttgaaangcagcagatggcactctggtgcttcctatgaagcaacatgcttgaaatcaagggccaacaattgttgtaggaaagcaaaatatacctctaacacctacgtttaccaaaaaagctgacatctcaaactctgagttgttgagactcaaatttctcatccccaaagaagcctattacggtagtgtgntggatgctttttgtatctctgataggcaggcactataatggggggaaatacttctgaataaaaacattggctgtcttgcaactgtgcatataatgtctattcaagggggcagtgtgcctagcatgatcctgaaatgttgagataaaaggaagttggcattaaagcactatttgtcttatatgaaaagagtgactctatcttccagtaaacaaganttcctgcaatgaaaaagaaattttttccttcattatctataaactatacaaaataaccttcctttttaacctaagactcaaacattnatatttgattttattctatttgataccaattggtatgtccag

SEQ ID NO: 473 - DNA, 264 bp, Homo sapiens
cctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcag

SEQ ID NO: 474 - DNA, 165 bp, Homo sapiens
aattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccag

SEQ ID NO: 475 - DNA, 417 bp, Homo sapiens
  misc_feature 370, 372: n = A,T,C or G
aagttctcttcttgttttaaacacattcctgataacttctaaagatgaccaaaataaaacagaatatctacagagatcattttctgaattttttgtacatccaaggataacaacataaaaaaaataaaactggacagcattccacatccaagtgcacagaaccatttttgcaagattaaataatgtaaacattgggaacagccaaatcagcgaagaatgccaacacctcaaaacacctggtgttgccgcttcattaagtggttcaaaatccagatctataattgcgcaatattcaccgtatataaaaagaaatggatattaattttgacaaatagctgcaactgagacttctttttatttctttatatgngnatatagtgaatttttattatttttaaaattttatttattttttta

SEQ ID NO: 476 - DNA, 321 bp, Homo sapiens
  misc_feature 36, 87, 102, 158, 170, 193, 196, 263, 291: n = A,T,C or G
catttaataacaaaaacaacctgtacggaaaacccnaaggcaaccacatagcatatgtaaaatgtgcaaatacactttaaaatgcangttattctatagcanttgcaagatagaatttcactgtaattagggaatctagctcatcctaacttaatagncttttgcatgtntagacaatgcaattctacaaggnacnactcagcgttgatgctaaagtatgaaacacatcctcagattattcatccgaaaatattaaaatagcntcatgttttattattctttaatgagtcntgagctcatttctaaagcttcataaagcat

SEQ ID NO: 477 - DNA, 546 bp, Homo sapiens
  misc_feature 546: n = A,T,C or G
gctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgcacggtacatgagtttcttgcaatgacaaatgaacagaaaacagcattaaagtggcaattcctcttggaaagaagcaaaatttatttaaaattcgttctatcacacagagcaaggagtggattgaaaattagtgtactctcgtgcaagcttgcagatcctactgaggcaagcagaaacttgtctggacaaagacatgtttaaaacggtctatcattttgaactctggaaaagtataagagttttaactccctttaaaatggaatattaatttgaaaattatggggaaaattgcattttgtttacatgtggtgaacatgtttctagaaattggtatggcgggaagggggctgggtgagtctgaaggacctcn

SEQ ID NO: 478 - DNA, 100 bp, Homo sapiens
aagaaaagtggtaaaatcaagtcttcttacaagagggagtgtataaaccttggttgtgatgttgactttgattttgctggacctgcaatccatggttcag

SEQ ID NO: 479 - DNA, 508 bp, Homo sapiens
  misc_feature 2, 3, 423, 505: n = A,T,C or G
gnnttccaaattcttctaactcttccaaaagccttctgccttagttttttttaaattacaccagtccttttagtagctttttgatgtgatttttaaccaacttccccttctagcttcaagtattcttctaaattggtcctggtctacgtaaacaccctcatcttctcaagctttaccttctaacttctgcaccaccagaaattaaattgatgggcttttaaaataaattggttaccaataatttcctcattttttcagtgctattttatccaatttttggctttatatttttctatcttctatacttctccaatacttgtcttagcttgtttttcattttctatctgaaactcttgacaatatcttctaatttccctatcttctctattcttttcttcgccttcccgtacttctgcttccagntttccacttcaaacttctatcttctccaaattgttcatcctaccactcccaataatctttccattttcgtgtagcacctggncag

SEQ ID NO: 480 - DNA, 81 bp, Homo sapiens
ggtgcccttttcctaacactcacaacaaaactaactaatactaacatctcagacgctcaggaaatagataaggaaaatgac

SEQ ID NO: 481 - DNA, 306 bp, Homo sapiens
  misc_feature 30: n = A,T,C or G
tcgccttcggccgccgggcaggttaggggnacaagacgctacttcccctatcatagaagagcttatcacctttcatgatcacgccctcatagtcattttccttatctgcttcctagtcctgtatgcccttttcctaacactcacaacaaaactaactaatactaacatctcagacgctcagggaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 482 - DNA, 582 bp, Homo sapiens
  misc_feature 92, 155, 262, 369, 393, 413, 430, 451, 452, 460, 463, 467,471, 474, 486, 516, 554, 558, 562, 565, 569: n = A,T,C or G
ggggggaacagtcattatacattatttagactcattccttcttccagtgcccttatgattatttcctacctttaccattgatcttaaactgngcaggctaaaaagaggaaccagaactcccttaagcacttttaagactatttaaaaaataaagntttgttggcattgaagagtaagctgcttaagggactgaatgaaaagatagtaccctttgtggctgtatgaagagagaaactgaatttctatccaagagaccttaatntagcctattagggaattatcttccccaaaagtacaagtaattttgcactgcaggagaaggataagtagatttgatttacatcacattttatacacacctttcaaganggagaaatctgcttcataaatagnaggaatctatgcttaaactnaacatttaatggtgacntcttacaacagccttgaaaannattggaantcngacntganggnggaaactggaanaaagaatatctttctcttctgcatcctttnatcctcaaacttagcatggattcacacgctgaggaaangttnggtnacnaccngaacatttagata

SEQ ID NO: 483 - DNA, 275 bp, Homo sapiens
  misc_feature 251: n = A,T,C or G
gcctcactaaaataacagatttcagtatagccaagttcatcagaaagacccaaatggaatgatttacaaaatagaacactttaaaccaggtcagtcctatctttttgtagctgaaggctatcagtcataacacaatttcgcgtacacctctgctcattatggaattacacttaaaacgaatctcaagagggtgaccattgttgtttcagataccatccctaaggagagtggttaacaggaagattgccagngttactgatggaaagaagcgcttg

SEQ ID NO: 484 - DNA, 434 bp, Homo sapiens
catatttccacaggccaatttctttctgtttttctgctaagctatttcagcattttagcttttcctctttgctttgtttactcatgattgccagatggctacgttacctctaagcatcagatcctcacaaattaatggttaaatgtaagggagggattttactctcttgcattaaaaaaaagctttattgagatataatttactgtaacattgactcatttaaagtatgctagtcaatagaccaaatcttgaataaactcccattcacaattgctacaaagggaataaaatagctgggaatatagctaacaagggaagtgaagggcctcttcaaggagaactacaaaccactgctcaagaaataagagaggatacaaacaaatggaaaaacattccatgctcatgaataggaagaatcaatatcgtgaaaatgg

SEQ ID NO: 485 - DNA, 291 bp, Homo sapiens
  misc_feature 1: n = A,T,C or G
ncaccactgcagccctacatacagttgaaaaaaaattccattctgttaacatttgttttataagttttcacgcaatacacaaaaaacccctctgcacttcttgtaaagaacaaaaaagatacacaacagttaagcgtaaagatcacaggcaatagcattcaaacatggatgtgggtagagaaaggagtacctggcatgagtacctgcttagtttgactgaatccttgatttttaatttggcttttcatgggccgctcacaacaccaacgctgtgtgaggtatggtagtcag

SEQ ID NO: 486 - DNA, 274 bp, Homo sapiens
ctgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgattgttctgtaactagttgctctcattttaatttcactgg

SEQ ID NO: 487 - DNA, 184 bp, Homo sapiens
  misc_feature 86, 132, 137: n = A,T,C or G
tggcaccaagattctcagctcacggtaccagcatctgattgtcggactacctgctgctttccctgatatttatacatgatattcgnaaaatgtaaagaagctattattcatacagacatctagagaaggagngaagnttttaaaaaaataaaaaaatacttatttcaagctttagctgtgttct

SEQ ID NO: 488 - DNA, 393 bp, Homo sapiens
ctgcatttttattgcgatctgcagatgaactggaaaatctcattttacaacagaactgggacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccag

SEQ ID NO: 489 - DNA, 607 bp, Homo sapiens
  misc_feature 46, 270, 440, 515, 558, 579, 580, 602: n = A,T,C or G
gtgcttatgtacttaaggggaactactctaactgggtgaagagtangatgaagcatccatgtccctacaaaggatatgaactcatccttttttatggctgcatagtattccatggtgtatatatgccacattttcttaatccagtctatcatcgatggatatttgggttggttccaagtctttgctattgtgaatagtgtcgcaatgaacatacatgtgcatgtgtctttatagcagcatgatttataatcctttgggtatatacccagnaatgggatagctgggtcaaatggtatttctagttctagatccttgtggaattgccacactgtcttccacaatggttgaactagtttacagtcccaccaacagtgtaaaagtggtcctatttctccacatcatctccagcacctgttggttcctgactttttaatgattgncattccaactggtgtgagatggtatatcaccgtgggtttgatttgcatttccctgatggccagtgatgatgaacnttttttcatgtggtttttggctgcataaatggcctgccttttntacttctataaaatttttcanntcttattattattcctgggggnttaag

SEQ ID NO: 490 - DNA, 179 bp, Homo sapiens
  misc_feature 76, 102, 131, 169: n = A,T,C or G
cttctaggaatactagtatatcgctcacacctcatatcctccctactatgcctagaaggaataatactatcactgntcattatagctactcccataaccctnaacacccactccctcttagccaatattgngcctattgccatactagtctttgccgcctgcgaagcancggtaggacc

SEQ ID NO: 491 - DNA, 399 bp, Homo sapiens
  misc_feature 41, 156, 371: n = A,T,C or G
cctctacctgtaatcacattaatttttctaaagacaggggnggtgttttgaagataaatgtcattagtctatgataatagcatcataggacaattagccattttagacttgaccatattttctctttttagcatatagccatcttgatatttaggngggagactactccaatggagcaacagtttcattttacatgattggatttagaaatttacaaattttaaactcataagaattctaaataatttgaaaatggaaacatttgacccacagtctagcagcataaatacatttataaaatacttcattgttgatcttaggtcattgatttaaaacagaatttggtgactatgggcaggtggagggggccngtgaggaaggtataaaagagaaatcttt

SEQ ID NO: 492 - DNA, 482 bp, Homo sapiens
  misc_feature 39: n = A,T,C or G
ctccaccttactaccagacagccttagccaaaccatttncccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggggagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtagg

SEQ ID NO: 493 - DNA, 207 bp, Homo sapiens
  misc_feature 35, 37: n = A,T,C or G
cataaatattatactagcatttaccatctcacttngnggaatgctagtatatcgctcacacctcatatcctccctactatgcctagaaggaataatactatcactgttcattatagctactctcataaccctcaacacccactccctcttagccaatattgtgcctattgccatactagtctttgccgcctgcgaagcagcggtagg

SEQ ID NO: 494 - DNA, 283 bp, Homo sapiens
  misc_feature 38: n = A,T,C or G
ccaattgatttgatggtaagggagggatcgttgacctngtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtagaccta

SEQ ID NO: 495 - DNA, 590 bp, Homo sapiens
  misc_feature 584: n = A,T,C or G
tatgtatataattttcttagttactagcatagagaaattactgatttaaaaaaacatttcaaattctagcatgttgtaggattctattgccctttctaaaaagtacatcttgcttatccgatttctaacaaaactatttaatttgaagaagggagaatgaatttggataaaaagcaaaaatttaaaggtactcaaatttaggcaaaccattaaagcaatcttagtttacagttaattgggtagaatggtcaacactttcttcaggttagttcatggagtggatatgcattgatagaacaacttagagatgcttttacagttgagaaagctcattatatttgttatctttaagaatcagcttatttatttcatatgtttgttctttaagaagaccaaagagccctgcaaatgaatgttgatttgtttttttgtttgtttaatatttttgtagagataagatctcactttgttatgttgcccaggctggtctcaaactctcaacttgaagtgatctgcccacctcagcctcccaaagtggtgggattacaggcatgagccaccgcacctggacctgcccgggcggncgctcg

SEQ ID NO: 496 - DNA, 307 bp, Homo sapiens
  misc_feature 20, 22, 25, 34, 118, 119, 155, 167, 169, 178, 188, 201, 212,230, 245, 259, 260, 268, 300, 307: n = A,T,C or G
ggagattagtatagagaggnanacnttttttcgngatatttggtcacatggataagtggcgctggcttgccatgattgtgaggggtaggagccaggtagttagtattaggaggggggnngttagggggtctgaggagaaggttggggaacagctnaataggttgttngntgatttggntaaaaaacantagggggatgatnctaataattantgctgtgggtggttgtgntgattcaaattatgngctttttcggaganncatgtcangtggtagtaaatataattgttgggaccattanttcttan

SEQ ID NO: 497 - DNA, 216 bp, Homo sapiens
  misc_feature 34, 35, 37, 124, 150, 176, 179, 183, 185, 188, 200, 203, 213: n = A,T,C or G
cattttcctcttggtttcttcagttaagtcaaanngncacgttcctctttccccatatattcatatatttttgctcgttagtgtatttcttgagctgttttcatgttgtttatttcctgtctgngaaatggtgtttttttttgttgttgntggtttttttttttttttttaaactnggnaccncnaanttgaaaaaatgnttntttttccctnaca

SEQ ID NO: 498 - DNA, 375 bp, Homo sapiens
  misc_feature 36, 37, 155, 227, 239, 242, 253, 279, 283, 286, 325, 330,337, 340, 349, 356: n = A,T,C or G
gaatttcctggcaccttttctcgctagagaagattnngtgtgactgggttgcctataagccatatagatacaaacttttatctctaataccaagtcttagagggatatattaatagatctaataaatttattcttagacttattgtttcatgggntagtgagtctttgctactggagacaatacagacttgtcagtttttttaaaaaaaaaaaatttgccaagctancacattaaaaanatntcctaaggctntcattttatgaggatgattataaacntttntgngataaatatcaccataataaactgttaagtacaactgcnggccncccttanagngaattcctncagttanaaatttatttttttgccaa

SEQ ID NO: 499 - DNA, 215 bp, Homo sapiens
  misc_feature 5, 39, 40: n = A,T,C or G
ccacnaaagcagaagcttaaagcatagtagtaaagaggnnaaaaagaaggacgaaaataaatcagatgacaaggatggtaaagaagttgacagtagtcatgaaaaggccagaggtaatagttcactcatggaaaagaaattaagtagaaggttgtgcgaaaatcggagaggaagcttgtcacaaaaaaaaaaaaaaaaaaaaaaaaaaatgtttt

SEQ ID NO: 500 - DNA, 489 bp, Homo sapiens
  misc_feature 38, 239: n = A,T,C or G
ccactacgataagcaggtagctgggttttgtagtgagnttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggnttgtctactttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgctta

SEQ ID NO: 501 - DNA, 286 bp, Homo sapiens
aaaaacactcaaacacagccttggagggaggagtcagttttaaaagactcttataaaagtaatatactgctagctctgaagaatcggaggctaaaatcatctcttcaagtccccagggaatcccaaagaactccaggggaaggtgggatgggccagagagctctggaagcttccaggtctgttgcaagcctcacctggtacacagtaggctcttccaggtctgtcaggaacccaggagcctcccctagcacacagtaggctcacaaaaagggagcactgctgctgg

SEQ ID NO: 502 - DNA, 168 bp, Homo sapiens
  misc_feature 38: n = A,T,C or G
cctatgattgtgggggcaatgaatgaagcgaacagagnttcgttcattttggttctcagagtttgttataattttttatttttatgggctttggtgagggaggtaagtggtagtttgtgtttaatatttttagttgggtgatgaggaatagtgtaaggagtatggggg

SEQ ID NO: 503 - DNA, 173 bp, Homo sapiens
  misc_feature 34, 35, 43: n = A,T,C or G
cctttataataaattaggcaaaaggttcagtgcnnggctatantggacaacatgaaactccataaaaatgactggatagggggactgcttgagacttttcttttgggcattactaacagaattcaaagaaattccaaccacgcttatttttccaaattctactgaaatgagag

SEQ ID NO: 504 - DNA, 310 bp, Homo sapiens
  misc_feature 127, 259, 273: n = A,T,C or G
tagtattctatttaaaaattaagttttggggtctgtaaaatatacaggacaatgacttttttaaaatgtaagttaatacctcctcctcacttgtcttaattgaacttaggtgtttattcttaaaggnggaccttgatgaaaatgttgagatgggaagtgttattaggcaaaacttgttatagatttctcatataactcttaattgacccttagaattttaacaaccgcgcctggcccaatagactgttttttagagtanttttaggctctcancaaaattgaggggaaaatacagggtgttcccattaaa

SEQ ID NO: 505 - DNA, 530 bp, Homo sapiens
  misc_feature 527: n = A,T,C or G
cctcagggaacttacaattatggcaaaaggggaaggggaagcaagcaccttcttcacaaggcatcaggagagagagagaaagagagtaggggaaactaccccttttaaaccatcatatcctgtgagaactccctcagtattagaagagcatgagggaaaccgcctccataatccaatcacctcccaccaggaccatccctcaatacatgggggttacaattcaagatgaggttcgggtggggatacagatttaaaccatatcagaatggttaatgatattgttgtattttaccaactataatcttcttagtgttatagtacaataatgtaaaaaattgagtaaatttgttttctatattattctgtttttggaaaacatgtatatagtcagggctgtttgtctcaagaaaatatggtaaactctgctgttttggtcactggtgcctagaatttggggatgtacattggttttgattcacatgcacatttccttctagttcacagtaactatttctaactatttcccnata

SEQ ID NO: 506 - DNA, 352 bp, Homo sapiens
  misc_feature 50, 175, 336, 337: n = A,T,C or G
cttgaacgctttcttaattggtggctgcttttaggcggtactatgggtgntaaattttttactctctctacaaggttttttcctagtgtccaaagagctgttcctctttggactaacagttaaatttacaaggggatttagagggttctgtgggcaaatttaaagttgaactaanattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaanntatttctagttaatt

SEQ ID NO: 507 - DNA, 370 bp, Homo sapiens
  misc_feature 35, 186: n = A,T,C or G
cctaactagatcttatcagaataggggggaagggngtcggttcatccttattgagtgttaatgaccctgtaagatgtaatttcttttatttcattctgttacctagaaaatctatcacagccttgtagtattgattgctcaatctataaagagctcagtttacagcatgactgttagtaacagggntattttaatgagtgactcttcaacacctcagagtttcactaaattccaacccatcagcccagtagtctaacattaagggtcttaggaaatgagaacttatcacctttccttatcatgaaaaggtaacctccaggtaaccaaaaatagaacttcctctgtgttcgttttttatagaaattactgg

SEQ ID NO: 508 - DNA, 129 bp, Homo sapiens
  misc_feature 37: n = A,T,C or G
ctgttaaaagaacaaacttagcaatatataacagttnggtaacaggatttttgactattcactttgggagttatttttaaaaatccacttttttactgagtcttactacataccaggcactgtacttgg

SEQ ID NO: 509 - DNA, 422 bp, Homo sapiens
  misc_feature 1, 52, 105, 107, 166, 176, 197, 232, 239, 241, 252, 255,280, 365, 416: n = A,T,C or G
ntgggaagtcgtgacatccatgggaacccagcgctgtgatgctggtgtttgngttctccgcgagaagtgaccattgttggagcaccatccagagctagtgaccantncagtggacagttagtgggagaatcaaaaatcctttccagaatgtctgtttctcactacntgcaccgggngattacaggcaccagtgcagngatgattgtacttatttgacacatactccccgtcntcctggntnttgttcctganaanggtgggtaaatattccaggaaaaanaatgcacattgaatggatgtgagagaccacattgcctctcccactgctttggggagcactttcctgtcatttctaacttaccacntgcttggtgtactatatgtatgttgtgcctcatatgttgcaaagaactaangtgagt

SEQ ID NO: 510 - DNA, 238 bp, Homo sapiens
ccacctatgaattggtggtttacctactcaatggatagcagcacgaggactgctgtactgcacaaaaagaagaccaaaagattacagtggaccatgggatacagaagccagcatggcagacagaagaaaaatagtttgggaacatgtaactatcctaagtggaagttttgttgtaggaattatagtaatcacaccacattacttggcctttcggtaatgtgaaaaaaaaaaaaaatcc

SEQ ID NO: 511 - DNA, 254 bp, Homo sapiens
  misc_feature 3, 34, 169, 228: n = A,T,C or G
ccnattgatttgatggtaagggagggatcgttgnggctcgtctgttatgtaaaggatgcgtacggatgggagggcgatgaggactaggatgatggcgggcaggatagttcagacggtttctatttcctgagcgtctgagatgttagtattagttagttttgttgtaagngttaggaaaagggcatacaggactaggaagcacgataaggaaaatgactatgagggcgngatcatgaaaggtgataagctcttct

SEQ ID NO: 512 - DNA, 269 bp, Homo sapiens
  misc_feature 38, 49, 103: n = A,T,C or G
cctacctgtaaactacagtactttatatatctatgggnttaataaaaanaaaatccacaaatcttaaaaaggaactttaaatgcagggctatattgaattggnaaactgcaacacaaactggcgcaacataggtaaatgaataccaatctcactctatgtgatgcaagcatgctactttcccactaatttaaattactttcaaccactatgagccagaatgcatgcctgaaccttaaactgcactttaaaaagtaacatcttggcctaa

SEQ ID NO: 513 - DNA, 266 bp, Homo sapiens
  misc_feature 34, 79, 137, 149, 154, 157, 217, 245, 251: n = A,T,C or G
ggaggggggttgttagggggtcggaggagaaggntggggaacagctaaataggttgttgttgatttggttaaaaaatantagggggatgatgctaataattaggctgtgggtggttgtgttgattcaaattatgtgntttttggagagncatgncantggtagtaatataattgttgagacgattagttttagcattggagtaggtttaggttatgnaccgtactctaggccatatgtgttgganattganactagtagggctagg

SEQ ID NO: 514 - DNA, 271 bp, Homo sapiens
  misc_feature 9, 32, 33, 39, 51, 52, 61, 62, 65, 75, 108, 112, 120, 123,127, 129, 132, 141, 142, 157, 173, 179, 210, 219, 220, 224,231, 232, 235, 240, 242, 245, 251, 259, 266: n = A,T,C or G
acatgcaanaaatcgagaatcttaaaaaacannacgaanctgccctggaanncttactggnntangatatttatnttgcggctgagatacttgaacaacttcggatcngaantagacaanaangggnanttntatactgcnncagaggttacacagntcattgtattagagangaacanatgggtctggtgttcacacattggggggaanatgggcgtnnacangagaggnnganaaacnanganagcctncctggttngcataanaaaaa

SEQ ID NO: 515 - DNA, 328 bp, Homo sapiens
  misc_feature 23, 25, 32, 64, 112, 125, 149, 157, 202, 216, 245, 256, 267,297: n = A,T,C or G
ccaatgaggggcaaagtgagcgncnagaagangttttgactgaaataaatcaaacacaaaaatntaagttcacagtgacagtttaaacaaaatccaaacaaactaacaacanaaacaccccttgntttgcctctagtggaaggtggganaacacaanctcgtcctaaaaattgactagtaaaggggaaaacccggtcatttncctactctttccangaaatatctaatgcaagaaagaacttctnctcattatacngaaggaatttngaaaaatgatgtatttttggaacacctaantgaaatactggaacctgggcaagttcaccac

SEQ ID NO: 516 - DNA, 220 bp, Homo sapiens
  misc_feature 1, 5, 52, 118, 162, 168, 174, 195: n = A,T,C or G
ncctnagttgaaggaccccatgtacatacaggccaggggagcagtactaggntaactagaaggatctcatccccatatgtgggctcatttcaagtctatggatgactaccttcattgntgtgtgcgagatggtttcaccccttgaaaatatgggcacttcancataanatagcnaaatctttataatgatcaatncatcctacctccttttacatgcatg

SEQ ID NO: 517 - DNA, 296 bp, Homo sapiens
tgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagtttctttttccgtgccgtgtattttttaattgatttttcttcttttacttgaaaagaaagtgttttattttcaaatctggtccatatttacattctagttcagagccaagccttaaactgtacagaatttccactg

SEQ ID NO: 518 - DNA, 299 bp, Homo sapiens
  misc_feature 36: n = A,T,C or G
gaagatagaaaaatataaagccaaaaattggataanatagcactgaaaaaatgaggaaattattggtaaccaatttattttaaaagcccgtcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaagg

SEQ ID NO: 519 - DNA, 464 bp, Homo sapiens
  misc_feature 455: n = A,T,C or G
gctgcacatcggaggaaaactcggtaaagcagaatgaggttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaggtatttcatacagtttaacagatcgggaaacttctgtgaatgtcattgaaggtgatagtgaccctgaaaaggttgagatttcaaatggattatgtggtcttaacacatcaccctcccaatctgttcagttctccagngtcaaaggc

SEQ ID NO: 520 - DNA, 221 bp, Homo sapiens
ctgatatctacttatttaacacaagtctctaatacaatacaattttattaattttattccacatgccccacattagatctctagactcattcatcctacatacctactttgtatcctttgacctacatctccctacttcctcctccagtccccaccccccacccactggtgctaaccactgtttcattccctttttcattctacatatgtgagatcatgct

SEQ ID NO: 521 - DNA, 312 bp, Homo sapiens
  misc_feature 37, 38, 238: n = A,T,C or G
ctgatagctttctcttcgcctagattaatatcttctnncttcccattcacagcccccaccgacatcaaagctttgctgttttatctgtcaaaaatgtcttcacacttttcattcttaaataaaagtgctgagtaaggacattttcacaacaaatttttattttacaaaacttacaatgatttgaatccaaaacaactttcattatttaactgtaaagtaaatatatattttattaggngtgtcttagttcattttgtgctgctttaacagtgtatccttgtgatagttgtggggtgggggaggggggaagga

SEQ ID NO: 522 - DNA, 336 bp, Homo sapiens
ccttctttccccactcaattcttcctgccctgttattaattaagatatcttcagcttgtagtcagacccaatcagaatcacagaaaaatcctgcctaaggcaaagaaatataagacaagactatgatatcaatgaatgtgggttaagtaatagatttccagctaaattggtctaaaaaagaatattaagtgtggacagacctatttcaaaggagcttaattgatctcacttgttttagttctgatccagggagatcacccctctaattatttctgaacttggttaataaaagtttataagatttttatgaagcagccactgtatgatatttttaag

SEQ ID NO: 523 - DNA, 172 bp, Homo sapiens
  misc_feature 1, 5, 9, 11, 21, 49, 56, 60, 65, 66, 83, 88, 92, 113, 129: n = A,T,C or G
ngacnggcncntggctatgtntatagatagggctttaaccactatctgngaagcangagngacannattcttgctctcacatnccacngganacgtatttctcttctcttacnagcgaagaaccatctntttctaaagcccccattctattgcccttgcttttctctggctt

SEQ ID NO: 524 - DNA, 471 bp, Homo sapiens
ccagacctgcagaaaaacttagcacagctcaatctgctgttttgatggctacagggtttatttggtcaagatactcacttgtaactattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaataagaaaaatgcagcaaacttttaataacagtctctctacatgacttaaggaacttatctatggatattagtaacatttttctaccatttgtccgtaataaaccatacttgctcaaaaaaaaaaaaaaccttc

SEQ ID NO: 525 - DNA, 332 bp, Homo sapiens
  misc_feature 5, 36, 60: n = A,T,C or G
ccccnctgtattccagcctgggtgaccccatctcanggaagaaaagttaccagatgtcgngggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaa

SEQ ID NO: 526 - DNA, 440 bp, Homo sapiens
  misc_feature 36, 241, 258: n = A,T,C or G
ccaggttacctcccctaacagatgtggtgttctgangggttggttaagtgcccgaggaaaataggccttaactgttaacatctacagagaagaaagcatggtcacactggcaaggagtaagaagggattgggtaaaagaaaatgggagagaaaagggaaaaaagttttggcaagacaattgttccctgctaagaagctgcagggtgaaagctttcctttcttctatttttgtttttaatgnctgtctctctgatcagnggaaaagtgaaaatttctagtatctagcactaacgtatgacccaactttgagggatcacaagctagaacaagttgaggatttaaaatcctggataattatatacttaaagttcatgagcataaagctcacttgaccatgcagaaatgctgggaagcagggtgcatggcatgggaatacatct

SEQ ID NO: 527 - DNA, 124 bp, Homo sapiens
  misc_feature 30: n = A,T,C or G
tttccatatgtctgttgggtgcataaatgncttcttctgagaagtgtctgttcctatcctttgccccctttttgaggacttaaatgttagacctaagaccataaaaaccctagaagaaaaccta

SEQ ID NO: 528 - DNA, 162 bp, Homo sapiens
  misc_feature 35: n = A,T,C or G
ctgcgggagaaatatggggacaagatgttgcgcangcagaaaggtgacccacaagtctatgaagaacttttcagttactcctgccccaagttcctgtcgcctgtagtgcccaactatgataatgtgcaccccaactaccacaaagagcccttcctgcagcag

SEQ ID NO: 529 - DNA, 409 bp, Homo sapiens
  misc_feature 34, 35, 270: n = A,T,C or G
cctttaaaatatagcttataaaatgtatactatnngccaggagagctcacatttttctgcagttttccagtggacctgcctatggaatactgtaaagaaaaatctgcaaaaatattcctagcaattgaatcagtgcttttaaataaaagaagtggagaggggcttggttaaattattctgacaagttttcttgctagtggttgccaaaattaaggatatttgaagtgtcctatcacccaaatttggctttaagaaaaagctatattctgngtctatagggtgaagcccacactatctgtgctgcattctcaatgatacaatacctatctggaaactttcctgttttgccaatgggtgcacaaatctaaaacattttatcacaaaaggtacttgaatttaaatttctttt

SEQ ID NO: 530 - DNA, 325 bp, Homo sapiens
  misc_feature 39, 47, 96, 254, 264: n = A,T,C or G
ccgccagtgtgatggatatctgcagaattcgccctttcnagatttgngcccgggcaggtccatggctaggattatagatagttgggtggttggggnaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattagtcggntgttgatganatatttggaggtggggatcaatagagggggaaatagaatgatcagtactgcggcgggtagg

SEQ ID NO: 531 - DNA, 173 bp, Homo sapiens
  misc_feature 37: n = A,T,C or G
ccaattgatttgatggtaagggagggatcgttgaccncgtctgttatgtaaaggatgcgtagggatgggagggcgatgaggactaggatgatggcgggcaggatagttcagacggtttctatttcctgagcgtctgagatgttagtattagttagttttgttgtgagtgttag

SEQ ID NO: 532 - DNA, 395 bp, Homo sapiens
  misc_feature 41, 331, 344, 369: n = A,T,C or G
caggtcctactatgggtgttaaattttttactctctctacngggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcanaaggtataggggntagtccttgctatattatgcttggntataatttttcatctttcccttgcgg

SEQ ID NO: 533 - DNA, 290 bp, Homo sapiens
  misc_feature 215, 216, 237, 244, 249, 265, 267, 283: n = A,T,C or G
ctgaaccattatgggataaactggtgcaaattctttgccttctctacttctcactgattgaacataagcttccagggctcccctgaaaaccaaaatgaaaacaatgtcaaaatattagataaatcacataaaacagttaaggggataccaatatataaaaattattaggtaagctcatttctggaactgttaatgctcggtttcacaatccaagnngaccaacagccttcactcagntactggnagtgntactatggttactacngntactacctttagtgtnaaaaact

SEQ ID NO: 534 - DNA, 334 bp, Homo sapiens
  misc_feature 43, 44, 96, 126, 219, 228, 239, 248, 263, 287, 299, 310,318, 322, 323, 330: n = A,T,C or G
ccgccagtgtgatggatatctgcagaattcgcccttagcgagnnagccgggcaggtccatggctaggtttatagatagttgggtggttggtggggnatgagtgaggcaggagtccgaggaggttantttgtggcaataaaaatgattaaggatactagtataagagatcaggttcgtcctttagtgttgcgtatggctatcatttgttttgagggtagnttgattagncattgttgggnggtaattantcggctgttgatganatatttggaggtggggatcaatanagggggaaatanaatgatcagtnctgcggcnggtnngacctcngccc

SEQ ID NO: 535 - DNA, 557 bp, Homo sapiens
  misc_feature 1, 536, 538: n = A,T,C or G
nccataagcttcagtgcgcaaaaggtcaaggccagtgttaatttgttatttcttaaataactttccctttcatttttaaattataaatttaacttctaacatgttttatggttaaaattgtacttttttcctttagcgacattcaaatgcatcacaatcactttgtgaaattgttcgcctgagcagagaccagatgttacaaattcagaacagtacagagcccgaccccctgcttgccactctagaaaagtatgtgtaaaactctgttcttgttcttctttcatattgatgctgttccatgtgttaccattgtgagtggttggtaagtgttccttatgtgggaatcatgtgccttgaaaataaccttgggtgggtgagaaggtagggaaacctgcttcttttatctcaagtaaaagttttggcagggtaaagaagataaatgacatttatatctagacttttgagttttccaattatttggtaaaaatgggaaattctgtagaagcccttccttaaaaatgggggaagtccatttnanaaaattaactggtaggtca

SEQ ID NO: 536 - DNA, 372 bp, Homo sapiens
  misc_feature 37: n = A,T,C or G
gttccaaccttcatttctgaaactgttctagagcacngtgtctttctcgtagttcataacttaccccttcagtctagaattagaattacattatctgttttactactttactagactgtaagctcctagaagataaggactagggagttcatctctgtattccaccagaaggtacagtgactcatatctagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataagggggaggaagtcactgg

SEQ ID NO: 537 - DNA, 284 bp, Homo sapiens
  misc_feature 37: n = A,T,C or G
ccttctgatgcaaacagaaaggaaatgttgtttggangccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttgg

SEQ ID NO: 538 - DNA, 293 bp, Homo sapiens
gtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtgtaaaaaggcttcacaggggaacattcttttctgataaaggaaagcag

SEQ ID NO: 539 - DNA, 468 bp, Homo sapiens
  misc_feature 5, 35, 36, 59, 251, 367, 436, 437: n = A,T,C or G
tttcnataaactttatttttagagcagttttaagnnggtagcaaaattgattagaaggnacagagatgtcccatacacctcctactcccacacatgcacagccttccccattatcaatagcccccaacagagggatacatttgttaacaactgacgaacctacatatcattatcacccaaagtccacagtttatattattccttctggagaattttcaaatacagaaattcctctaccaggaataaactancaatttcctctcggctttctataaatttaattattatttcagaaattagcctatctttacaggagaaaatgttataaaccatgaaaagactatcaaatacacaaggaagtgaatgntatataaaaaatgtaccatctcctaaacaactacctgcattcccttcttgttggtaagttataatttgnnatagttctgatcatctgtttaattaatttgc

SEQ ID NO: 540 - DNA, 397 bp, Homo sapiens
  misc_feature 35, 360: n = A,T,C or G
ctgttttattaattcccccatttgcagcacacttntctcttccaacattcatcagtcagatcagagtccacggtcttttcaaaatttagataaactggcttacattttgtaatgatgtccccagacaacaccccactccaacccattctgtttgttactattagtttacaacatgcatgtgcctttactttcattttcatagtatttaaaaatggaagggcactcccaaatttactttaacccctttaataatctctctcctcctgctctctctggtcctccagacaactgttgatttactttcctttatgatggattagtttgcattttctagaattttatatgactgacatataaagnttttatgtttctcccctttgggtttcttcatgtggca

SEQ ID NO: 541 - DNA, 248 bp, Homo sapiens
cctagataggggattgtgcggtgtgtgatgctagggtagaatccgagtatgttggagaaataaaatgtgcatagtgggggttttattttaagtttgttggttaggtagttgaggtctagggctgttagaagtcctaggaaagtgacagcgagggctgtgagttttaggtggagggggattgttgtttggaagggggatgcgggggaaatgttgttagcaatgagaaatcctgcgaataggcttccggc

SEQ ID NO: 542 - DNA, 366 bp, Homo sapiens
  misc_feature 75, 123, 364: n = A,T,C or G
aatcggccctctagatgcatgctcgagcggccgccagtgtgatggatatctgcagaattcgcccttgagcgatancgcgggcaggtccaattgatttgatggtaagggagggatcgttgaccncgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtanac

SEQ ID NO: 543 - DNA, 460 bp, Homo sapiens
cctactatgggtgttaaattttttactctctctacaaggttttttcctagtgtccaaagagctgttcctctttggactaacagttaaatttacaaggggatttagagggttctgtgggcaaatttaaagttgaactaagattctatcttgggcaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaag

SEQ ID NO: 544 - DNA, 116 bp, Homo sapiens
  misc_feature 42, 46, 95: n = A,T,C or G
ccgccagtgtgatggatatctgcagaattcgccctttggagngctngcgcccgggcaggtctgtttcagcagctcctccttcttcttcccgcgangatctcgagccttgatcttgg

SEQ ID NO: 545 - DNA, 380 bp, Homo sapiens
  misc_feature 13, 18, 102, 104, 123: n = A,T,C or G
cgacggatcgatnagctngatatcgaattcggacgagcatggcgtattgctgcagatatggattcttcagaatgctccatgacaaatgtactgacgggaagncnatctaaaggaggcattgtnatgagagaaaggtctcgagctccagataaagagagatacagagttcttggaattggagttgcagaaacagtaagacaatcgattgtggggaagcgttcttttagagaatctttggccttcactccaaagcgttgttcttcatcaataataagtagctcgtgccgaattcctgcagcccgggggatccactagttctagagcggccgccaccgcggaggagctccagcttttgttccctttagtgagggttaatttcg

SEQ ID NO: 546 - DNA, 418 bp, Homo sapiens
ccagggcaattaggcaggagaaggaaataaagggtattcaattaggaaaagaggaagtcaaattgtccctgtttgcggatgacatgattgtatatctagaaaaccccattgtctcagcccaaaatctccttaagctgataagcaacttcagcaaagtttcaggatacaaaatcaatgtacaaaaatcacaagcattcttatacaccaataacagaccaacagagagccaaattatgagtgaactcccattcacaattgcttcagagaataaaatacctgggaatccaacttacaagggatgtgaaggacctcttcaaggagaactacaaaccactgctcaaggaaataaaagaggatacaaacaaatggaagaacattccatgctcatgggtaggaagaatcaatatcatgaaaatgg

SEQ ID NO: 547 - DNA, 172 bp, Homo sapiens
cctgaggttgggagaaattttgtccatttctttagaaccaaaattggcaaccagagagtatttggatgttacacaaaatatctagtttccctttctagcctaaattgggttgtttatagcacccgtctctccatttgagaaaaatggttaggatgctggtgcagggatgagg

SEQ ID NO: 548 - DNA, 367 bp, Homo sapiens
  misc_feature 340: n = A,T,C or G
ggtctgacttaagagaaacaatggaaggcaagaggcagtagaataatatattcaaaagatgcaaaggaaaaaaacctctcagccacgaattccttatccagcaattatttttcaaaaatgaaaataacacaaagacttagccagataaacagaaacattaactgaagttgttgctggcagacctaccatataaaaataaaaaactctaaaaaaattcctatggctaaaagcaagttacagaagacagtcacttgaatccacattttaaaaaaagcactgatatacgtaatattgacattataaaagacagtaaaaatgcatttcttctttataataaatngcttattaaataacatgtgtataatgg

SEQ ID NO: 549 - DNA, 418 bp, Homo sapiens
ccaaatcagaacctagagtgagcattctataaactcacctttgctttgatccttgaagatcacaagttttgatactgttgaaatctctactctttcaacactttaattaaatggcatttagaatttcatatacttctgttgttgtttccacaatcttaaactggatttagaaatacttataatgtaaatgcaagagctttaacttagtaaccgtatttcctattttttgttgtttttcttttgccagaatttctgtttgtctacaataaagtccagcgaaatacagtatttggttaggttacttgttaacataaaattttatcatttgtagagtttttacttaaccttcctattctctagtctctataatctttcaatgaagataaccagttacgaatatctcctataccatattagg

SEQ ID NO: 550 - DNA, 234 bp, Homo sapiens
  misc_feature 15: n = A,T,C or G
cctacccgccgcagnactgatcattctatttccccctctattgatccccacctccaaatatctcatcaacaaccgactaattaccacccaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgat

SEQ ID NO: 551 - DNA, 542 bp, Homo sapiens
  misc_feature 13, 14, 29, 160, 190: n = A,T,C or G
cacccctaccccnntcctcataaaagttnctctccctggatcctctttttccctcatgagtgcccggttgcccaagtcaaaaacctgggagtgatataaactccccacacatccagtcagtcactcatcaactctattgattctgtctgctaaatatatntcaattgtattaacttaaacatatgcatanggcactttcttcttcactgcatttttgtgggctgcacttacctttcaggtaacgacaacactggcccctcttgcccttctagtcagaagtgccaaaatgatgagagctagccatgacaaacccacagccaacattacactgaatgtgcaaaactggaagggcatccaaacagaggaggggagagaggaatagacaggaagtcaaactgtctctgtttacagatgacatgtttctatatctataaagccccatagtcttggccccaaagcttcttctgctgataaactttagcaaagtcttagcatacaaaatcaatgtgcaaaaattactaacagtcctatacatcaagtca

SEQ ID NO: 552 - DNA, 411 bp, Homo sapiens
  misc_feature 6, 25, 209: n = A,T,C or G
cctggntgacaaggaggtgcctgtnatgtgaagatttgaggaaagagcattccaggcagggggaaggcttgatgcaaagggtctactgcaggcattagctgagcttatttaaagatcagaatgaaggccattgtggctagaacagagtggacaggaaggaatggtaccaggcaaagctgaagaagttggcaggattgagctctcataantcatggcaaagagttcccatttcattgtttgacggaaataaattggaaggtcttaagtaggagaagatttgattagatttacattttacgaagaagcactctggatgttatgtgaagaaatggcctttgcagggcaagggtggaaacaaagagatcagttaggaaattattggagtagctgaggattggatgaggggatgtg

SEQ ID NO: 553 - DNA, 631 bp, Homo sapiens
  misc_feature 395, 574: n = A,T,C or G
ccgggattagaactaaaacaagtgagatcacccctctaattatttctgaacttggttaataaaagtttataagatttttatgaagcagccactgtatgatattttaagcaaatatgttatttaaaatattgatccttcccttggaccaccttcatgttagttgggtattataaataagagatacaaccatgaatatattatgtttatacaaaatcaatctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttanaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaacgacntttatcttcaaaacaccaaattgtctttagaaaaattaatgtgattacaggtagagg

SEQ ID NO: 554 - DNA, 558 bp, Homo sapiens
  misc_feature 6: n = A,T,C or G
ccaggntagtctccaactcctgaccttagctgatccacccacctcggcctcccaaagtgctgggattacaggcatgagccactgcgcccggccaaacttgatatgcatttttaaataagttaatacattattcatggtttagtctcattatatattctatggtccactttgaaatttcatctaaccaaaatcatcttcatcctgcaatttgaggtttggacacaatggggattgatcagtaatttcttcatatgccctttctcaaggaaatagtttcctatgaaaaaaaagtcctatgttttcatgtaagttctctttttggagaagaaaaggagacattcttacttagcactctcagttttacaaaacgctgccaaccttaaaatttgtctattgattcccaaggcacacaaccaatagtctgtcaataacccggaataacatttctttaaggccccagtaactttcacatgtttgggttccaatcctcacctagaatcttgttaagaaaagtaaaccattcactcctctagaaactctaaggttgcttcttagggg

SEQ ID NO: 555 - DNA, 212 bp, Homo sapiens
ccaggtatttgcataatggcttttcttctgttgcctttgttcctttgtggccccagctaattgcctgagagtgccactgttagttttcaactctttctgatagaaaccctgtgtactaacatggaaatcttaggtaatctgctttttcaaagcacaatgcagaatttattggcggtggtgtaactttaagaatatccgagaagccaccaagg

SEQ ID NO: 556 - DNA, 219 bp, Homo sapiens
  misc_feature 214, 216: n = A,T,C or G
ccatgtgtctatctggagagaaggggaaacagcaagtgcaaaggccctgagatggaacatatctggagaattcgaagaatggtaagaaggccagagtggagcagaacaagtgtgggagagagttgtaggagatgagatcaaaggctaggaatgaagtgtaaggccatgtcatgtgaccttgtatgtccttgtaaggcttttttttttttttttnancct

SEQ ID NO: 557 - DNA, 482 bp, Homo sapiens
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttccatcgcctatactttatttgggtaaatggtttggctaaggttgtctggtagtaaggtggag

SEQ ID NO: 558 - DNA, 679 bp, Homo sapiens
  misc_feature 5: n = A,T,C or G
ctgtnaaaattctgaacctatccccaaaagaaaaaccgtgaaatacaagttttaggaggtggagcaaagaaaagccaagttatttaaaaccaataaacacaagagacaattctgctggagaatttactttctccaaaacatcaaatggactttaaagcagaagaccacattttatgagaaagttatgtcactgaaaagcttcatgtaaagtgactttgtaaatggaatatttttaaatgataaaaagaaaataacttttccaggaatcctttggagaggctgataaccagatattaaattatcaattttgccaaagtggacttttaaaaaatgtgttacttttaaaaactaacttgaaagaatttatgaggcaatctatctgagtatgtttattgttgctccattggctttcaggattttggtcatttcactgttaactcttacatcagagaataaagaaaagaaaatgaaactttgttaggaactgggatggaaaatgtagtcccagacagatctactgacctcgactgagtttcagaaatatcccaggattttggttattcatgcctttcttttgtgactttctttcaaattagccaattaaagataccccttcaatcaccggtgacatcagtacaacagtttttcaacagttttctctctcctgaccaaacagttt

SEQ ID NO: 559 - DNA, 488 bp, Homo sapiens
  misc_feature 393, 407, 420, 450: n = A,T,C or G
ccccactgtactccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaacaagggctgtttttgctgccccaaaagggcttaacaatttaggcggatagtttacttaaaaaaaaaaatcctttggagacatactgaaaatgcaaactagtttctaaattatcaattccctacatgaanaagcagtttgccanagtttagtctcanaaaatgactggttggctctatttaaatcanaacccaatttctacgcacctgcccgcccggccaagggc

SEQ ID NO: 560 - DNA, 602 bp, Homo sapiens
  misc_feature 5, 566: n = A,T,C or G
cctanttaagaattccttgccttagtggtgaacaaggactaaacacagacaatgggtgaaacacagacgctaattcacataacagagagtaggcaaccttaagaatgaattgatgcagactcctatagaattcctctgttatgactgggttcttattttctcctccttgtatgtagttgaaatttcatcattatgaatagttccttggatctttttttaaagttgtgaatgcgagtgtttggctttgtaatacaactttttagtatccagaagataaccagtgctctaccaataaagatcttttgatacaaagggttttaacttctgccagttcttactcatttttttcaggttttttatacatttcttaaacaacacatacattatgtaaaatataagaattaatgtacattctcaaggccagattcagtgacaaaatgcactacccgaatctagtaacacatttactccttgctgcatataagtggcgtgtaagaaatacagggtatattgttttgtgatccatgcagtaaatgttcacaaatatcaggcaaacaactagacgntcttcagctactaaaattaactgtcccagtcacaaa

SEQ ID NO: 561 - DNA, 683 bp, Homo sapiens
gtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaagacattactgtaatatcaaaaaccgtggcagtttgtatacaactctgggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgt

SEQ ID NO: 562 - DNA, 420 bp, Homo sapiens
gcactttttttccagtaaggattcatctcttgctctcctatatggtcattatattttatattttacatatttataaacatgacatatgtatttatgttccacaaagggctttgaatagaatttacacatagagttccctgggttgatgtgtttatcaaaatggaagataaagtgaattaattacttaaatatttaacactattgaatagaaataatttccccaatattgcttcatgatttagacagtctattaaatgtttaagcaaggcactagactaagtttattaagacaaattttggaatatgtgcagaaatatgacctggctaatagtacagagtcaaagctggttgaatggtgttatatagtggattcagattgatgtggcagtggtggttacactaggggcactaaggttatcc

SEQ ID NO: 563 - DNA, 482 bp, Homo sapiens
ctccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgggcctggtgatagctggttgtccaagatagaatcttagttcaactttaactttgcccacagaaccctctaaatccccttgtaaatttaactgttagtccaaagaggaacagctctttggacactaggaaaaaaccttgtagagagagtaaaaaatttaacacccatagtagg

SEQ ID NO: 564 - DNA, 302 bp, Homo sapiens
ctggaagtgaaggtactaatatacaaatggctcttgtttctgaatatgtgatataatttgtgaatctttggaaactgaattttttctatggagtgcaaatatagaagggttattttacaatgtttgttgtgaaaagaattcactttgtaaacaactattaaggctggaagtttagtgaaggtgcatagttttgaaagctacacaggtgaaaaatcaaacttattgtttgtaattttgctgttacatgttaagttactttgacagcaattttctaatgataatgtgatttatgatttaaaagg

SEQ ID NO: 565 - DNA, 554 bp, Homo sapiens
  misc_feature 4, 5, 37, 38, 550, 551: n = A,T,C or G
ccanngtgacatcatggcaatacagcaagaattctgnnatttatttagaagcctcaaggagaaggatcctggagcccctgaatgagagtttcttctccatgcctctccccagtcaaaatacatggaaatattcatagaagcattgtacccagcatgataaggaaggatggagaatggttccttatatctctgttcacaagacatcaacactcttaagtaactgtatgaaataaattctctgctgaaagcaaataaaccatctgaaaggtcttctggttacttacacagatttcctagagaatctgaaatcagcctaacagggaagattaatttttaaatgaatccaagttaatgaaagcaaagaactcttatacagaaatacattttcctattataaagcaggactaccttccctaatttctgatagacctaggacaatttgaatgggcattgaaattcttttggttgaattacgcaaacaagcaaaggaaaagtctcaattattattggaaaatttggggagagattattatctcttgatctcctagtnnatt

SEQ ID NO: 566 - DNA, 631 bp, Homo sapiens
  misc_feature 1, 14, 15, 35: n = A,T,C or G
ncgaagctgtgaanncattcacacggaatctgganggtattactgtaacttcttataatacataatataaaagtttttgaaagatatagacacaattaacccctaaacaacacactatctgattctcaaaagcaatggctatttaacaagatgtaaaaggacaataacatatcaaagaactttcacacacctaaagatagcatttagcagcaagttagtcagacaaaacaaacataaatatcttcacatttcctatgtttgtttttaactttacttcataaagccactgataattgaggtttctttcaagtataagatttctaaaattaaaaactgtttttgacatatttttataaagaaataaaaagcaaaacgcaatccaactatttatatgagtccctcttctccaacagctttagatgtttttctgagtactttttacacagaatatttttattaaaatcagttctaattcatttatgcagattaggggaaaatgattcataataaattaactttaaaattaccttctatctgcttctacctctatccccccatcaccaccaaatctgttgctacagtgaactgtagccaatgtctgtttgagggggcccaaagcatctggtaatct

SEQ ID NO: 567 - DNA, 510 bp, Homo sapiens
  misc_feature 6, 39, 87, 97, 111, 113, 161, 163, 179, 210: n = A,T,C or G
cctatnatagcttctctagctatcatactccaatcagcnaaaaatgagaaaatgttgagaaatagaagataattcctcatttaaggncaccttctanaatttgtgcttaanantctgttttcttctcatgggccagcacttcggcaactgggaaaaattangngtacagggatctaggnaatactgtttatttgagcaataatatattgngctaacgttcaggcatcctattactgagaaataagggaaaatgagtgtaaagtacaactaagagtctcggctacagggaaaaataccatcagttaaatatccatagtcctagagcatttatgtaaaactgcaatttgaatcctgcaatacattttggctttttcctcagtgataccatgtgtgggaagttgttctgtcaaggtgggtcggataatttgccctggaaaggacggatagtgactttcctgacatgtaaaacatttgatcctgaagacacaagtcaagaaataggcatggtgg

SEQ ID NO: 568 - DNA, 180 bp, Homo sapiens
  misc_feature 6, 11, 34: n = A,T,C or G
ttaatntgacncacgcttatgcggaggagaatgntttcatgttacttatactaacattagttcttctatagggtgatagattggtccaattgggtgtgaggagttcagttatatgtttgggattttttaggtagtgggtgttgagcttgaacgctttcttaattggtggctgcttttagg

SEQ ID NO: 569 - DNA, 237 bp, Homo sapiens
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgtcaggaaaagggcatacaggactaggaagcagataaggaaaatgactatgagggcgtgatcatgaaag

SEQ ID NO: 570 - DNA, 352 bp, Homo sapiens
ctgtctctccatttagagccccagttggtcctgacctcttacaaatttggtgttttcactttgatgtttatgaaccgattgcattaaaaatgcaggataatgattcagggttagagaaactattatttatacaaatgtggttaacacctcatcattttaaattggctgtgctaataatgctcattgtgctcttcagggttatgtgtgtgtgtgtgtgtgtgttttgcctgaatctgcaacctacatttgctctggcagtatgttgagtatatgctagaatagaatggacctaggcaactctaaggtcctacaactaaatacacttacttaggaaacctcctaaataagtagg

SEQ ID NO: 571 - DNA, 402 bp, Homo sapiens
ctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttgtttctaccttgaggtcttttgacatgtggaaagtgaatttgaatgaaaaatttaagcattgtttgcttattgttccaagacattgtcaataaaagcatttaagttgaa

SEQ ID NO: 572 - DNA, 70 bp, Homo sapiens
  misc_feature 57: n = A,T,C or G
tggatccgagctcggtaccaagcttggcgtaatcatggtcatagctgtttcctgtgntcgttttacaacg

SEQ ID NO: 573 - DNA, 423 bp, Homo sapiens
ccaatggtttcttagtgaaagagtacactagctctgaatgcaatgccctcagaaagatatcattcatagagacatacaaagcacatggcaacatgacattggaatacacgattctgagcatcttcattcatgaccaacctggctatagatttcagatgtcctcttggctcgaaggatatctgggatatccatgctcacttgcattcctttccctttaatttcattttctaagtccttcttgtattgtttctaaaagaacagaaaataatcttggagctttgcttaagctttaatagcgatgttgaaatttacatgtttgaatctcaaagccacccatgtggaaagaaaacttatgctctttccagctatgattcacggcatttattttaaactttgtatcttgctgctgtcttacctggctgg

SEQ ID NO: 574 - DNA, 129 bp, Homo sapiens
ctgttaaaagaacaaacttagcaatatataacagtttgctaacaggatttttgactattcactttgcgagttatttttaaaaatccacttttttactgagtcttactacataccaggcactgtacttgg

SEQ ID NO: 575 - DNA, 684 bp, Homo sapiens
  misc_feature 7, 40: n = A,T,C or G
ccagatntgacttttcaaaactactcacattgtgaaaaangcaggaacaaatctagtttcaagttcagcatgccgttccctgtttaattcataaaacacaactggcagaagtattacttgaagcaaaacaaaagtaacgtgggaacttgcttatttgctaagccacaatgtatttttccaggaatagcataaatttgccatctttcttgtgtctatggaaaaggggtttagaattgtttcactaaaaattaaatttctatattgtcaaacatgattgtatactcaaattttaaaatgtgaagggaacacttactaagcatttcctgggtatgccactatattaagtcctagtaatatgatatagtttatttcaattttttttcaactcatacttcctttaaaatagcactgaccaaaagaaagttaacatgagcttcatgtacaatttttaatctttttgcagaaaaataaactgagaaaggctaaaattgttttatttaagccactataccaagacatattgatttcaccaatataaaaattgagatagtttacattttttggtacatctttaaaatctggtatgtatttttatactgacagcacatctcaatttggacaagctacatttccagggctcaatagtcaccatgaatctcaattgtaatcaaagaggttggcctg

SEQ ID NO: 576 - DNA, 134 bp, Homo sapiens
ccttatttctcttgtcctttcgtacagggaggaatttgaagtagatagaaaccgacctggattactccggtctgaactcagatcacgtaggactttaatcgttgaacaaacgaacctttaatagcggctgcacc

SEQ ID NO: 577 - DNA, 133 bp, Homo sapiens
  misc_feature 14, 25, 27, 34, 117: n = A,T,C or G
ctgtctctccattnagaagccccantnggtcctnacctcttacaaatttggtgttttcactttgatgtttatgaaccgattgcattaaaaatgcaggataatgattcagggttaganaaactattatttatac

SEQ ID NO: 578 - DNA, 200 bp, Homo sapiens
cctcaaatctatcttcaaaggtgacccagcaatcagtgtcaatgcctttactgtagttaacctggtaatttcattctttagtctctccaagaaaatctgaagtgtattaggcaagtcagaacccaaattgtctccaaggttgcaaataatttgtcccatacaggaaatagccctttccttgacttcctgatcaatgtcag

SEQ ID NO: 579 - DNA, 402 bp, Homo sapiens; identical to SEQ ID NO: 571

SEQ ID NO: 580 - DNA, 245 bp, Homo sapiens
  misc_feature 80, 114, 217, 233, 237: n = A,T,C or G
ccaattgatttgatggtaagggagggatcgttgacctcgtctgttatgtaaaggatgcgtagggatgggagggcgatgangactaagatgatggcgggcaggatagttcagacngtttctatttcctgagcgtctgagatgttagtattagttagttttgttgtgagtgttaggaaaagggcatacaggactaggaagcagataaagaaaatgactnttagggcgtgatcatnaaangggataaa

SEQ ID NO: 581 - DNA, 294 bp, Homo sapiens
tgcagcgcaagtaggtctacaagacgctacttcccctatcatagaagagcttatcacctttcatgatcacgccctcatagtcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 582 - DNA, 230 bp, Homo sapiens
gaggtcgccctcatagtcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 583 - DNA, 481 bp, Homo sapiens
ccaagggtgttctgcctgcctcagcctcccaaagtgctgggattacaggtgtgagccactgtgcctgaccacaggaaaacttatttaaatgagagatttgactcgaaagatcccgtttttttaaggctcttagttcttaaaagcggcacataatagaattagtataatcccaaataaattttcagtagatttttggtgtaacttgagaagatgattctgtcatttttagtgacaatttaaaagacctgaaattgtctacagccatagaaagtgaactactgatagttgtttctgtaaagttttattggaacacaaccacacctatttgttcatctgtattgtctttggttactttgtgcagagaccatggcccacaaacctaaaacattcactttctagctctttaagaaataattggcccactgacaccctggtcttaaggtctagaccaattatttctcaagagtattagctgaatcag

SEQ ID NO: 584 - DNA, 306 bp, Homo sapiens
ccaattaagagctaaatttacaaaataatctctatcaggaggctttaaggtttaatgtctctaaagtccctatggatataagaggcttgaatgtactgaattcaaatttggtttttaaatgttataatagtttaggcccgagagccacatatttctgtctaagaatagaaagcatagctagctgcccacacagaatattcatatagaggtggggggcaagaacaaaatttattcatttgatacatagaaatgggactacttagaatagactcataatagaaagcatcatctggtttctcatctcag

SEQ ID NO: 585 - DNA, 308 bp, Homo sapiens
ccagaatggtacagagtggagggtgttctgctaatgacttcagagaagtatttaagaaaaacatagaaaaacgtgtgcggagtttgccagaaatagatggcttgagcaaagagacggtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactagaacaccagctcctttataatgcatgtcag

SEQ ID NO: 586 - DNA, 416 bp, Homo sapiens
  misc_feature 105, 119, 132, 139, 140, 144, 159, 160, 208, 226, 230, 247,250: n = A,T,C or G
cctgtctttgaatggatgaaataggttaataaaaaacatcactgtttaaaaactagaacactgaaaaattctaggaaagcttattttcccttatatttttatggnactttcaacacttnacaacactatttnaattaanntttnttctagagtttatannatatcagtacattcttttctgtggatgcaataatatagaatcttattncaaatcttactggcaggntctnttaaattcttcaacggntgncatagtgattaaccaaaattagttatgatttctgcctatctgtgtgagaacttacaggggaaattgttctaaacctgaggaacatgaagtaactgtactgcacactccaaatgatgacagtcattttatatcaccttcaattacccaacagcttttaatagtctgg

SEQ ID NO: 587 - DNA, 382 bp, Homo sapiens
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttc

SEQ ID NO: 588 - DNA, 307 bp, Homo sapiens
cctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggactaatacccatatttctcgagtagggcaggcaatggcgtccacagaggaaaaagcctatgagatcatgagggagctcgatgtcagctatgtgctggtcatttttggagg

SEQ ID NO: 589 - DNA, 89 bp, Homo sapiens
cctgggtgattgaggatgcaatgagctgtgattgtgccaccacactccagcctgggcaatacagcaagactgtctcaaaaaaaaaaaaa

SEQ ID NO: 590 - DNA, 456 bp, Homo sapiens
cctcagttcttgattgtggttgacggggcgtcaccatgaaggagcccatttagtataaagcttccaaccttttctcttaatcgtttctttaatcttttaaaccatcttcaagtgcataggggagtttccgatgccagaggatgaaagcaagtgctctctccaccctctcctcccagagtgaaaacaaatccttttgctgatacttgtttcaaaagcatccattgtaaagcttctcagtgacacaaaatactgagaggtaactttttatcaatcaaaccacataccccaatttaacacctttcaatgctctgaattcaactgacagactaaagggtgtttcctgtaacagtctgaaatattaagtgttttttttgttttgtttttaaatcttatttcagaaaacttcctcttggggtaggaaagtacacatgaagcagcaaagtaacgaagaaaaac

SEQ ID NO: 591 - DNA, 289 bp, Homo sapiens
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtagacctacttgcg

SEQ ID NO: 592 - DNA, 435 bp, Homo sapiens
  misc_feature 250, 316, 325, 392, 430: n = A,T,C or G
cgcgttagatgcgccttttccggcctgtgcgtctgctctggttcctctcaggcagcaaagctggggaaggaagctcaggcaggagcctccccgacaccacagcggcacaagcagcagctaaagcaccgcactttgctctgctaaccttttacttaaatgaggttttgccaaatccacatctggaaccgcatcacacccatttgcaaggatgtttgttctttgatgaaactgcatctctactgcacatganggctttcattgtaggacaagaggagagttcgtttatttttgtaactgttttacatgttccgattanttaatcggnagcttatgtcatttgctatgcctgttgtcttctaatctctccttactaaaacattacttcaaatttnaattgacccttgtttataatttatttaacgggatttgngtgtc

SEQ ID NO: 593 - DNA, 633 bp, Homo sapiens
  misc_feature 35, 620: n = A,T,C or G
ctgtttagtcagataattgtgtccgaattgattangaaaataatagaccagccataaagcagcataaaatattatgaaactattccagaagttcagtaatatctttgggacctgctcatagcccaagttttgtgaatacttttgtagttaaaaaaaatttttactttaccagggcattgcaattcttttccatcagtgaatttcattctacagacttttcagagcatctcataatcagtcaacaaatctatttcaaatgtgtttgttactaagcaacggttgctaagagcttctgtaattaagatgaaagttccaaggtaacaatgcccaaacacagcaccattttcaccattttctgataatgcaggagtaggatggctaaaagtgaaagaagaatctactctatggaaagcatggcacctgaaatttctgaagatattggctgtcctctagcttatatgagagagagtgtttgtgctttactaatcaaccagtcatttttttcttgtgtggctgaaatgtacattccagacatgaacaggtagagtatgtgttgggggcaggtttatactgcatgggtgtgctgagacagggccacgtggtgatgtaaatgatgctgnctgacacgtgcag

SEQ ID NO: 594 - DNA, 501 bp, Homo sapiens
  misc_feature 34: n = A,T,C or G
cctttacaagatgctggtaccttgatcttggacngggcaggctccaagatggaaagaaagtgagcatctgctttttagggattatccagtctatactactctgttctagccacacaaaacaggttaagacagaaattggtaccaagagtggggtgttactacagcaaatacctgaaaatgtagaagaggctttgaaatgtggtaattggaagaagctggtagaatttggaggagtaggctagaaaatgtctgtattttcatgaatggagcattaagaataattccggtgaggccatagggaaagtctaaaacttttcagaaattatgtaagcgattgtgattagtaggttggtagaaatatagacagtaaaagcaattctgatgtggtttcagaggaaaatgaaaaatattagaaactgaaggaaggggcatccttgctataaactggcaaagaacttggctgaaatgtctccatgtccaagagatttatggcagaaatgt

SEQ ID NO: 595 - DNA, 383 bp, Homo sapiens
ctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccag

SEQ ID NO: 596 - DNA, 266 bp, Homo sapiens
ccatggctaggtttatagatagttgggtggttggggtaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattagtcggttgttgatgagatatttggaggtggggatcaatagagggggaaatagaatgatcagtactgcggcgggtagg

SEQ ID NO: 597 - DNA, 383 bp, Homo sapiens
  misc_feature 35: n = A,T,C or G
ctggtcaccatcatccctttaatcaactcacaccngtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccag

SEQ ID NO: 598 - DNA, 266 bp, Homo sapiens
ccatggctaggtttatagatagttgggtggttggtgtaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattagtcggttgttgatgagatatttggaggtggggatcaatagagggggaaatagaatgatcagtactgcggcgggtagg

SEQ ID NO: 599 - DNA, 294 bp, Homo sapiens
  misc_feature 201: n = A,T,C or G
ccaattgatttgatggtaagggagggatcgttgaccacgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcanataaggaaaatgactatgagggcgtgatcatgaaaggtgataagctcttctatgataggggaagtagcgtcttgtagacctacttgcgctgca

SEQ ID NO: 600 - DNA, 213 bp, Homo sapiens
agatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcctttagg

SEQ ID NO: 601 - DNA, 471 bp, Homo sapiens
  misc_feature 1: n = A,T,C or G
ncctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggt

SEQ ID NO: 602 - DNA, 482 bp, Homo sapiens
  misc_feature 32: n = A,T,C or G
tgagcatacagcaataaaaataacataatttntatgtgtacaatatttatggaatacgttactggaacagataaataatttagttaataacatgacaaagaacagaaattgtatacactatacagcatagtaatagaataatgaatgattaaagttattaatattaggtagaaaatgaagggtatctttgagagcagaactcaaggaagcaagcaatttgccttatgaggaaagagttacctgtggataaaggagaaactgaaaaatttacaagtcaagactttttgagcaaaaacaaaaatatgactatgagtcaccaattcagtacagtgaaaaaaaagttgaagagatatcttggaagtaaaccatgttgtggaagagcagggttttgataatcatgggattattctgaatgaattttaaatgcgataggaatatatgagataatttcaccagagaataatatgatcatgtttgcattt

SEQ ID NO: 603 - DNA, 372 bp, Homo sapiens
gttccaaccttcatttctgaaactgttctagagcactttgtctttctcgtagttcataacttaccccttcagtctagaattagaattacattatctgttttactactttactagactgtaagctcctagaagataaggactagggagttcatctctgtattccaccagaaggtacagtgactcataactagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataagggggaggaagtcactgg

SEQ ID NO: 604 - DNA, 468 bp, Homo sapiens
  misc_feature 3, 37, 199, 412, 460: n = A,T,C or G
gcngttttgagtgagtttcttaatcctgagttctggnttgattgcactgtggtctgagagatagtttgttataatttctgttcttttacacttactgaggagagctttacttccaagtatgtggtcgattttggaataggtgtggtgtcgtgctgaaaagaatgtatattctgttgatttggggtggagagttctgtanatgtctattaggtccgcttggtgcagagttgagttcaattcctggatagccttgttaactttctgtctcgttgatctgtctaatgttgacagtggggtggtaaagtctcccattattattgtgtgggagtctaagtctctttgtaggtcactaaggacttgctttatgaatctgggtgctcctgcattgggtgcacatatatttaggacagcnagctcttcttgttgaattgatccctttaccattatgtaatggccttgnctcttttg

SEQ ID NO: 605 - DNA, 288 bp, Homo sapiens
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtagacctacttgc

SEQ ID NO: 606 - DNA, 572 bp, Homo sapiens
  misc_feature 5, 399, 483, 488, 532: n = A,T,C or G
gaatnaaatgaatgaaatagaaaatataattgagagcttcaacaacagactataccaaatggaggaaaaaatttctgaacttgaagatagatcttttgaaataacacaagcagtggcaaaaatgaattaaaaagaataaggaaagcctaaaggatttatgagatatcattaagcaagcaaatattcatactatgggcattccagatggaaaaaagaagggtaaaggtgaggaaatcatatttaatgaaataatagcagaaaatttccggagtcttgggagagagatgagcatttaggtccagggagctcaaagaaccccaaacagattcaacccaaacaggtcctctctggagcccaacatagtcaaattgtaataagtaaaagacaaagaattccaanaagcattcaagagaaaagagtcaagtcataaataagggaatctccattaggctaacagcagatatctcagcagaaagcttacangccangagagaatgggatgatatattcaaagtacttgaaagcaggggtnggggaaaccctgctagctaaaaatattatacccttgcaaa

SEQ ID NO: 607 - DNA, 178 bp, Homo sapiens
  misc_feature 37: n = A,T,C or G
ctcggggtaatctcccagcaagaggtcaggtcctggntgtgcgtcccagggtgtcagtgaaattggctgctcccctgacccagggcaccttcatgcgtcttcacagcaggactactgtgaccaaggccagacctttcatctttcaaaagactttgactaaaaatgctttaaaaaagca

SEQ ID NO: 608 - DNA, 416 bp, Homo sapiens
cctgtctttgaatggatgaaataggttaataaagaacatcactgtttaaaaactagaacactgaaaaattctaggaaagcttattttcccttatatttttatggtactttcaacacttaataacactatttcaattaagttttctcctagagtttatagtatatcagtacattcctttctgtggatgcaataatatagaatcttattccaaatcttactggcaggttctcttaaattcttcaacggctgtcatagtgattaaccaaaattagttatgatttctgcctatctgtgtgagaacttacaggggaaattgttctaaacctgaggaacatgaagtaactgtactgcacactccaaatgatgacagtcattttatatcaccttcaattacccaacagcttttaatagtctgg

SEQ ID NO: 609 - DNA, 648 bp, Homo sapiens
ctgatctctcagcagaaactcttcaaaccagaagagagtgggggccaatattcaacattcttaaagaaaataattttcaacccagaatttcatatccagccaaactaaccttcacaagtgaaggagaaataaaatcctttacagacaagcaaatgctgagagattttatcaccaccaggcctaccctaaaagagttcctgaaggaagcactaaacatggaaaggaacaaccagtaccatcgaggctaggaagaaaccgcatcaactaaggagcaaaataaccagctaacatcataatgacaggatcagattcacacataacgatattaactttaaatgtaaatggactaaatgctccaattaaaagacacagactggcaaattggataaagagtcaagacccatcagggtgctgtattcaggaaacccatctcaccgtgcagagacacacataggctcaaaataaagggctggaggaagatctaccaagcaaatggaaaacaaaaaaaggcaggggttgcaatcctagtctctgataaaacagactttaaaccaacaaagatcagaagagacaaagaaggccattacataatggtaaagggatcaattcaacaagaagagctaactatcctaaatatatattgcaccc

SEQ ID NO: 610 - DNA, 310 bp, Homo sapiens
ccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttacacaaactgttttgaggctcttaccgtagtcgaaggtatcttagatcttccttagtgatctcattaagaatatccgaaagtgtataaccctcttcaacaatctgaaacaaagatcagatccttaagagctgagcag

SEQ ID NO: 611 - DNA, 254 bp, Homo sapiens
  misc_feature 39: n = A,T,C or G
ctgtttttacatctaaagcaatagactagaactgaattntcttctacatagtaaaatcacaattgtggaattacaggaattctggtgatattaaggtgaaacaacaaaacacaaaaggccctattttaacagttgatgtgacagtaagttttaatagaacctgtaacttcattttggaaatgcttctccaccaaataaggcctttttcccctatttaaggagccagatggattgaaagatgtggaaataggcag

SEQ ID NO: 612 - DNA, 225 bp, Homo sapiens
  misc_feature 40: n = A,T,C or G
ctgactatatcatgtcaccatcatagccaatacaacattnttgccatacttcctaaaaaccttttcgcatacactgatcatgctacttatcagcactttctaacatcctgaccaaacagacacccacacctcttatagagtacactgtgagagaataacatggacttgatatggcatcacacttgttttaaagcaaaaaaaaaagaaaaagaaaagaaaaaaaaa

SEQ ID NO: 613 - DNA, 471 bp, Homo sapiens
  misc_feature 226, 236, 243, 281, 324, 365, 370, 373, 376, 383, 400, 412,429, 431, 458: n = A,T,C or G
ccatcagacttcttgggtgcctggctatattcaatgtgaagtaaaaaatatcccaagtcttacaccaaaatagaggctctgacttagaagtatgcttttagctttctttttaaataagacattctggaagaaaaaaaaagaaaaaggaaagaaaatcaagtttgaaacacagttaacacttattttggcaagaaagcaaccaaaatctaaaaagcataaactatgngtccaaatgnaaaaggnattacagaacaaactgcaagaggggaaaattaaagccncactgaacgaaaaaatacagtatgtctaacattttggaattgnaatttaaaccctaagggcaaaagctgaaaaatcatgcttanacctnggncgngaccacnctaagggcgaattccancacactggcggncgttactagtggatccnanctcggtaccaagcttggcgtaatcctnggcatagctgttt

SEQ ID NO: 614 - DNA, 421 bp, Homo sapiens
gttattttttagaatggctctcccatcttgagtatgtgtgatgtttcctcatgtatgaatgaagcatatacatctttgtcagaagtatcccagaagcaattctgtactctcctcattatgttctattgggtgggccatggtttttgatttgtctcattactgatgatggttacttttattatttgataaaggttgtatataacttatctattatggcataatacattagctaaaaccttggcggtgtaaaacagcagatacttacgtttctcataggaatggctctattgagtacctctgtctcaaggcttctcaagagtttgtagctaccttgttggctggggttgcggtctgacctaaaggcttagttagggggtggtagaaatcttccatatgttctttgctacgtggacctcacagg

SEQ ID NO: 615 - DNA, 242 bp, Homo sapiens
cctcctatttattctagccacctctagcctagccgtttactcaatcctctgatcaggatgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttgg

SEQ ID NO: 616 - DNA, 392 bp, Homo sapiens
  misc_feature 79, 91, 105, 110, 128, 141, 149, 163, 172, 178, 193, 206,215, 264, 270, 276, 284, 297, 305, 315, 335, 342, 350, 351,359, 373, 392: n = A,T,C or G
cctaatttgtagattgtgaaagcagcttttagtttaacttatttacagaccccttataattaccatgtttttttttttnttcctaaatctnttggttcagcttgngaatnttacgtgcccgtaaagtngggatgttgaatnggcccttntttgttctggcagngagtcaagngtccancattttttcataagngttttttaaaatngttctccancattttatggctcctccctcccatgtcctcaaacccagcaaaagcgtanaggcanaattanaggacccncccgggcggccgntaagggcnaattccagcncactggcggccgttactagnggatccnagctcggnnccaagctnggcgtaatcatggncatagctgtttcctgtgan

SEQ ID NO: 617 - DNA, 215 bp, Homo sapiens
cctactatgggtgttaaattttttactctctctacaaggttttttcctagtgtccaaagagctgttcctctttggactaccagttaaatttacaaggggatttagagggttctgtgggcaaatttaaagttgaactaagattctatcttggacaaccagctatcaccaggctcggtaggtttgtcgcctctacctataaatcttcccactatttt

SEQ ID NO: 618 - DNA, 433 bp, Homo sapiens
  misc_feature 8: n = A,T,C or G
cttttgtntgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacccataatggatttggttaatgacttatgagcaagctggtttgg

SEQ ID NO: 619 - DNA, 259 bp, Homo sapiens
ctgcagtgtccctttttatatcatgctagtgttgagacatacttgactaacttgggaacagttcgatatattgacaaccgtcaacttaagaaaatcaacagcttttggccccagcgtccaagtgaacttttcatggagtgcagaatctcaaatggacaaaatactttgtctttttaaatactgaaaatttaattattagtactatgactgaaagattcttcatggctaaaaagctctgcatcaaactcaattcaggagg

SEQ ID NO: 620 - DNA, 393 bp, Homo sapiens
ccaccaaagccacacggagattctgtcaggcgctgagacaccacagccttttcaatcttagggaaagaaatcaagtcatataaattaatatcaacaggtaaggtcattgagcaattgtctttcaactgtctaagactttatcacttaagatcataaacacagaagcaggtcataaaaatagcttttcttaaggtttaggagaatttgtaggggcacttacttgataatctgaattttctagtcagaagtttaaataccaccttttaaaaacataaaatttaatttgtaacaagttattaacaaagcagtattgtcgaaagttttaagctttctcccaataatttaattacattaattaaatttttaccattctaatggttacaaagtaaccag

SEQ ID NO: 621 - DNA, 563 bp, Homo sapiens
ctgacaatgataaaattatctctatatgggcaaacgcgtgctctttgtcgaagaagaaagcttcagcttcatgttccaggtgagttaattaggcaatgtatgaatgctaatatctctttcacatattttgcttaagatctgtcttaggactctcgtctggcccatatggttttccaagggcagaagggcctctttttgatgagaggcagttttcagtaactcttaaagtgataacagcaaaggagaggagagagaagagtaagacaaatcgaaacattcttcaattgcttcttggccttttggctaagctcaagctcaaaacaggtcttcaaggagaaaatacatcacaaagaaaaggatgttttatttcttaccttgtcctagaaaaatttccataaactctattggcttaattctgtaaacttgaccaatatcagagtgcttcctaccaaggagggtagctgatgagcgtgaccatggtacatcctagaagaatgtgtgatgaagaagctttcaccgtgtaaaagagttgaaaattattcaaggagacattatggtcttgg

SEQ ID NO: 622 - DNA, 505 bp, Homo sapiens
  misc_feature 194, 436, 484: n = A,T,C or G
tcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatgnttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgnctataaggaaattattccttgtagctaatacatttttcattttgcagnccaaatcttttttgagaaagg

SEQ ID NO: 623 - DNA, 489 bp, Homo sapiens
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgctatactttatttgggtaaatggtttggctaaggttgtctggtagtaaggtggagtgggtttg

SEQ ID NO: 624 - DNA, 233 bp, Homo sapiens
gttggggaacagctaaataggttgttgttgatttggttaaaaaatagtagggggatgatgctaataattaggctgtgggtggttgtgttgattcaaattatgtgttttttggagagtcatgtcagtggtagtaatataattgttgggacgattagttttagcattggagtaggtttaggttatgtacgtagtctaggccatatgtgttggagattgagactagtagggctagg

SEQ ID NO: 625 - DNA, 459 bp, Homo sapiens
ttcgagaacatttttaataaataatgtgacaaaattacttttctgattattggattttcagtatgcaaaattatggctaaaaataaggggcttcttacatgaacataatgaaaacattaatcacatggattgttcccttagtactgcacgccttttctatggaactttttcaaattatctaaatgaacaagtttggttttggtgaacaccagcctttttttttgtggttcagttttgtttggctttgtcttccactggggtcagacctgatacttatctatctatgaataaatgtacatttttttcttcaaatagcaccaattataaaatcaatgatattcataaaatgacaaaaaaggatcatagaaatctactagtcagagggcatcatttgtcaattgaaagcaagtaatgcctctattagagattttaaggaaatcttgtaggtttcgacattgg

SEQ ID NO: 626 - DNA, 458 bp, Homo sapiens
cctgatgattgttttaaacagtagaaagggttcagctaagaactacagtccactctcagccctgtcatgtactataggacaagtcttcattcacaacaaatggatagcaacaccaatctcgtaacactgggaaaactgcatacaatatttagaaggaacactaatacagcagaatctgcacacaacggagtcaaagatctgaggccaaatcctactacactttacgactttgagttggtcacttttctgaaccttagcttctccatcagtgtaaaactgatgtaaaataatataaagctatatgaaagctgatgtgatttacttgtgaaatagtatgtgcaaaaggactttgtaaaatgtaaagcactatgctggttattgtgatatctgagatatttttaaagttgcaattcaattcaacaagcattcatttagagtcatgtgcaaggcactgtgct

SEQ ID NO: 627 - DNA, 393 bp, Homo sapiens
  misc_feature 5, 6: n = A,T,C or G
ccatnngaacgcactcaggaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacatttgattggaccgacatatacctgtgggctaggacttccagga

SEQ ID NO: 628 - DNA, 233 bp, Homo sapiens
  misc_feature 35, 36, 192: n = A,T,C or G
ctggatttataaaatagttgaatgacaaaagaagnntgttttgacagtaaaaaaaagacattatggacaaaatatgcaaaatgtgcaaagaaaaaataaatttgcattagaaaggtgggcatttgatctctgagccctgtgccatgtaacattgccatgttctttcactgttgtttgaatgttgtaccccancccttgactctggacttaaggcaagctatgactggctttgg

SEQ ID NO: 629 - DNA, 450 bp, Homo sapiens
  misc_feature 3, 11, 240: n = A,T,C or G
ccnggacaatntaggcaggagaaggaaataaagggtattcaattaggaaaagaggaagtcaaattgtccctgtttgcagatgacatgattgtatatctagaaaaccccattgcctcagcccaaaatctccttaagctgataagcaactccagcaaagtcgcaggatacaaaatcaatggacacaaatcacaaacattcttatacaccaataacagacaaacagaggccaaatcacgagtngaactctattccaattgctttcaagaaaattaaaatacctagggatccaacttacaagggacatgaaggacctcttcaaggagaaactacaaaccactgctcaatgaaataaaagaggatacaaagaaatggaagaacattccatgctcattggtagcttgatggggatggcattgaatctataaattaccttgggcagtatggacctca

SEQ ID NO: 630 - DNA, 486 bp, Homo sapiens
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggtagtaaggtggagtggg

SEQ ID NO: 631 - DNA, 211 bp, Homo sapiens
tttacataaatattatactagcatttaccatctcacttctaggaatactagtatatcgctcacacctcatatcctccctactatgcctagaaggaataatactatcactgttcattatagctactctcataaccctcaacacccactccctcttagccaatattgtgcctattgccatactagtctttgccgcctgcgatgcagcggtagg

SEQ ID NO: 632 - DNA, 293 bp, Homo sapiens
  misc_feature 191, 262: n = A,T,C or G
cagcgcaagtaggtctacaagacgctacttcccctatcatagaagagcttatcacctttcatgatcacgccctcatagtcatttttccttatctgcttcctagtcctgtatgcccttttcctaacactcacaacaaaactaactaatactaacatctcagacgctcaggaaatagaaaccgtctgaactangctgcccgccatcatcctagtcctcatcgccctcccatccctacgcatcctttacataacagacgaggtcnacgatccctcccttaccatcaaatcaattgg

SEQ ID NO: 633 - DNA, 263 bp, Homo sapiens
  misc_feature 1, 194: n = A,T,C or G
nggtctgcagtgtccctttttatatcatgctagtgttgagacatacttgactaacttgggaacagttcgatatattgacaaccgtcaacttaagaaaatcaacagcttttggccccagcgtccaagtgaacttttcatggagtgcagaatctcaaatggacaaaatactttgtctttttaaatactgaaaattnaattattagtactatgactgaaagattcttcatggctaaaaagctctgcatcaaactcaattcaggagg

SEQ ID NO: 634 - DNA, 491 bp, Homo sapiens
cctactatgggtgttaaattttttactctctctacaaggttttttcctagtgtccaaagagctgttcctctttggactaacagttaaatttgcaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggtagtaaggtggagtgggtttgg

SEQ ID NO: 635 - DNA, 270 bp, Homo sapiens
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcg

SEQ ID NO: 636 - DNA, 383 bp, Homo sapiens
cctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcc

SEQ ID NO: 637 - DNA, 537 bp, Homo sapiens
  misc_feature 26, 516: n = A,T,C or G
ttttaatcctggggtatataggcagnactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgngtgcacttcctgctttttagg

SEQ ID NO: 638 - DNA, 445 bp, Homo sapiens
  misc_feature 15: n = A,T,C or G
ccagcagaacacagnagtgatttggtcccgtttgttccccagtggggtatctatccttgtgcagggcacaagcctacatggtggctctggtcatatcattagaaaatagacagaaatgggctgcacaccagaatgaatgaattgaattgaaagggaggagtgatggtggaaaaaaaaacaagtcaattcatttagactggtagaaccagaaccactgtgtagtacatccaaacggttaaaattccctggaagatgttacataatcctatcatggtgtttatttatggaaatctattttaaaaattttatgtaatactgcacagtctgtttgcatgatgccttgtacgtagtagcaactcagtaaatactttttgaatgaactagtatagtattttaattagctagtcttcgtgtactggtacaaaagaacagtgtcatcttacag

SEQ ID NO: 639 - DNA, 584 bp, Homo sapiens
gcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcaagaggtggcgaaacccgacaggactataaagataccaggcgtttccccctggaagctccctcgtgcgctctcctgttccgac

SEQ ID NO: 640 - DNA, 404 bp, Homo sapiens
ccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatataggagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctgg

SEQ ID NO: 641 - DNA, 138 bp, Homo sapiens
  misc_feature 127: n = A,T,C or G
ctgtgacaggaacattacctgaagtgcagggtggttacctgcacaaagtcccatttccaaaaatttctgtgtaattcaccagaaattttggatggaataattagaaaaaaaaaaagaggttaaaacntgtaactcaaa

SEQ ID NO: 642 - DNA, 381 bp, Homo sapiens
  misc_feature 372: n = A,T,C or G
ctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcctaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtanaaattaaaa

SEQ ID NO: 643 - DNA, 403 bp, Homo sapiens
ccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacag

SEQ ID NO: 644 - DNA, 688 bp, Homo sapiens
  misc_feature 653, 666: n = A,T,C or G
cctatttatttgttttggccctggatctttcctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagcttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgcttttcttcaaacctgncagctcaactgangaaagacaggtacttccattgc

SEQ ID NO: 645 - DNA, 484 bp, Homo sapiens
  misc_feature 460: n = A,T,C or G
ccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatgggggggggtctcggatttcactaacgttgtatatgaaaatgggtgcnataaaaagtacttttaaactttgt

SEQ ID NO: 646 - DNA, 447 bp, Homo sapiens
  misc_feature 413: n = A,T,C or G
gggtcgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgnacaccattgtgtgtttgtaaaatgtgtatgtccc

SEQ ID NO: 647 - DNA, 388 bp, Homo sapiens
gaaggtgatataaaatgactgtcatcatttggagtgtgcagtacagttacttcatgttcctcaggtttagaacaatttcccctgcaagttctcacacagataggcagaaatcataactaattttggttaatcactatggcagccgttgaagaatttaagagaacctgccagtaagatttggaataagattctatattattgcatccacagaaaagaatgtactgatatactataaactctaggagaaaacttaattgaaatagtgttattaagtgttgaaagtaccataaaaatataagggaaaataagctttcctagaatttttcagtgttctagtttttaaacagtgatgttttttattaacctatttcatccattcaaagacagg

SEQ ID NO: 648 - DNA, 632 bp, Homo sapiens
  misc_feature 12, 24, 33, 483, 539, 626, 629, 630: n = A,T,C or G
cctggctgggcntttgacctgcgnttttaaatnactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagatagatgtcaaagnatgattggtggagggagcaaggttgaagataatctggggttgaaattttctagttntcattccgtacatttttagttagacatcagatttgaaatattaatgttacctcctcaatggggtggtatcagacctgcccgggcggncgnntc

SEQ ID NO: 649 - DNA, 300 bp, Homo sapiens
  misc_feature 1, 15: n = A,T,C or G
nggtgaagatagaanaaatataagcgaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggctttggaagagttagaagaatttggaagg

SEQ ID NO: 650 - DNA, 498 bp, Homo sapiens
  misc_feature 1, 4, 8, 26, 255: n = A,T,C or G
ngtnctgntaaacagaagggtacaangcccttctggctttaagcagtcataggaatgtgacagacattcctcttagggagcgcctcctcctagggtttcctcatctgtctcacactgagtggatgtaatgctattttaatcctgctgtggcccccaatactagtacttgtccataccttcttgcatttttagcgtctgctctgtggggttgttaggccctggcactcccaggaactagtgctaaagctgcatctntctctcccctctagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacag

SEQ ID NO: 651 - DNA, 654 bp, Homo sapiens
  misc_feature 149, 268, 375, 508, 578, 595, 615: n = A,T,C or G
ctgagggtccccaggtttctaaagctctcaggacgagaaagtaggtcccaagataaggagcctaaagggcttttttctttctgtgtattccttcttggcctccaacatgggtacagtcacaagagcatgtaacagagaagaaggactanacctaccattttctggataaagaattggaaagaggatccacaggtaaccaaaaagtaccagggaaatggcagagaaggaaaacctcaggagaccaacctcataagtggtatttattagngcctgggctcaaatccaaattgtacatgaatatgtctggtcctagatagggtaccgaagactttgaaagtgaattttggtatatcattgcccagattccagactggntattgtgtgacacaacatacaggatatatctgaatagtgctcagaagagtttgaaaatgcaaatgatattaaaataaagatgaaaaagagaaagctggtcagaacttgtggacataacccttctggatctgtngcctgattaaaaaatagttgatattctcgaatgaattaaaacaagatttagagactgagcatggtagctnattcttgtaatccaacnctttgggagggcaaggcaanagaattgcttgcggccaggagttttgagaccagcttggg

SEQ ID NO: 652 - DNA, 293 bp, Homo sapiens
  misc_feature 1, 193: n = A,T,C or G
ngtctgttgcactgaggtgactaaggatacattttgaggaagtagctccaagaacatttccattttcactgtgccttcacatacatctaatggaaatgaacagcacccttcatccatccacggaagcgattaagaaaagggtgggatggaaaaattaacccaacaatattagatcaatacgtagtatttaagngtccataatgtgccaggctgaagatgcacgggaaaaccacactagccggtctgtcaagggcttgagaataccataaacaagaaaacagacgaaccaattt

SEQ ID NO: 653 - DNA, 294 bp, Homo sapiens
  misc_feature 1: n = A,T,C or G
ngtccaccactgcagccctacatacagttgaaaaaaaattccattctgttaacatttgttttataagttttcacgcaatacacaaaaaacccctctgcacttcttgtaaagaacaaaaaagatacacaacagttaagcgtaaagatcacaggcaatagcattcaaacatggatgtgggtagagaaaggagtacctggcatgagtacctgcttagtttgactgaatccttgatttttaatttggcttttcatgggccgctcacaacaccaacgctgtgtgaggtatggtagtcag

SEQ ID NO: 654 - DNA, 250 bp, Homo sapiens
ctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgagg

SEQ ID NO: 655 - DNA, 494 bp, Homo sapiens
ccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcag

SEQ ID NO: 656 - DNA, 477 bp, Homo sapiens
cgcgttactgtacatattgctagcaggagacaactggaaatactaaacaaatactggaattcacattacagacagacgaaaccaacatggatgccacacataacttcctttgtagtttcacagagggcctatttgtggttgctcaggtggggtcatacattgcttgcagaaatggcctgatcatagctctatgaaacaatgaattcggaatgaaatcttaccatgacacctctctgtaggaaagaaatgttgcttcacgtgtgctaagttgagataataatatttcacatatttatatacagagaatcactctcaaatttaacccaagataagcaataggatttgggggtgacttgtacacatttctaacaacacttttcttttttctagaggtcactctcaaacactgatatatcactatagtttgagtgtagggattcagtaatcaaaggttgttattgcaaaagagccaggcag

SEQ ID NO: 657 - DNA, 576 bp, Homo sapiens
  misc_feature 13: n = A,T,C or G
cctctacctgtanatcactatttttctaaagacaatttggtgttttgaagataaatgtcattagtctatgataatagcatcataggacaattagccattttagacttgaccatattttctctttttagcatatagccatcttgatatttaggtgggagactactccaatggagcaacagtttcattttacatgattggatttagaaatttacaaattttaaactcataagaattctaaataatttgaaaatggaaacatttgacccacagtctagcagcataaatacatttataaaatacttcattgttgatcttaggtcattgatttaaaacagaatttggtgactatgggcaggtggagggggccagtgaggaaggtataaaagagaaatctttatgaattgtgttcagattgattttgtataaacataatatattcatggttgtatctcttatttataatacccaactaacatgaaggtggtccaagggaaggatcaatattttaaataacatatttgcttaaaatatcatacagtggctgcttcataaaaaatcttataaacttttattacc

SEQ ID NO: 658 - DNA, 344 bp, Homo sapiens
  misc_feature 14: n = A,T,C or G
cctgaaaagaaagntgctcttatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccag

SEQ ID NO: 659 - DNA, 230 bp, Homo sapiens
ctgctttccctgctaaacagttccagagcaaaagcagcaaaaagaaaatatgggagggatatgggcaacgtatactcgaacgtacgcagagaagagagtacggttagctctaatatttctcattgaacttggtggtatgtgccttccctgcatataaggccatagtgcttttttgggagcgctagaatatccatccacttgacagtgaccacaaaataggctgtttccag

SEQ ID NO: 660 - DNA, 80 bp, Homo sapiens
ctggtccttgttaaactcgatcaccactttggagagatcgactggaggctcctgggtgttctgaggggcctgggggacag

SEQ ID NO: 661 - DNA, 535 bp, Homo sapiens
  misc_feature 411, 413, 416, 422, 439, 470, 471, 479, 490, 492, 496, 501,511: n = A,T,C or G
ctgaaccatatctgattaactctttggtctctgttattggaacaaaaccgacgctatgcctgcagccgccagactgcaaccaaaaacacagtttggggtcagaagacattaaaaatcacaataaaataggatgaatgttctaagtcacgcaactgaatcaaggcacctttttttttcaaaagcaaaaagttgtttaacaatattccagaatagtagatacttcaaaaaccagattacagtatatatcattttgctgcacattttagtctattttctgtatacatagtcacacattctttaccctctcccaacttatacatgctttatccccccagtcatgtgctatgtaggtataaaaaaataaagttgtatctaaacaagtgatttaaaaaaaaaaactaacgaatgccncnatnataacnctgaacttgtttccctnttgaaggacattggaaatgttaccgaggttnntttacctnggccgcaaccncnctangggcnaattccagcncactgggggccgttactaggggat

SEQ ID NO: 662 - DNA, 257 bp, Homo sapiens
cctgactaaagcacatatcacactccctacacttccatgttttctctcccatgtggaccctctgatgcatatcaagattcaagcgcctgttgtagcccttcccacagtcctcacatttgtatggcttttctacactgtgaactttttcttgcactttagagaatgaattctgtacaatgttcttcccatgctgctcacatttgagaggtgtttctctgctgtggcgtctctgatgggtcagacgagttgaggaccag

SEQ ID NO: 663 - DNA, 516 bp, Homo sapiens
  misc_feature 36: n = A,T,C or G
ccaattataggtattttattttttaaagattagagngttcttgaagctctttctatttctttgtcaatgaactaaacattggcaaatatgtagggtttcccacataagaacattattaacatcaaaatagaaagctggtggtagaaataatgattgggaacacagagtctctactcagcgttctacttctgccataccataactttgtgatctcacgaaatatctctccatgttctcatccctatgtatagttctgtcatttttcaataagagctttttgcttaattatgaagtactagttactataaccattattttgagcttcatgtaaatcaagaacacatggactccacttgcaaaacattgaaaatgtagttagggattgggggcaaaaagcaacattttaaaatgtgtaaagacaatgagtaagcaacaaagtgtccaattttttaggcgaaagttgcatatgtcaggaaaaggcaggattaagtaatagagaatttgaatgataactgg

SEQ ID NO: 664 - DNA, 212 bp, Homo sapiens
gtccgaggaggttagttgtggcaataaaaatgattaaggatactagtataagagatcaggttcgtcctttagtgttgtgtatggctatcatttgttttgaggttagtttgattagtcattgttgggtggtaattagtcggttgttgatgagatatttggaggtggggatcaatagagggggaaatagaatgatcagtactgcggcgggtagg

SEQ ID NO: 665 - DNA, 408 bp, Homo sapiens
  misc_feature 11, 18, 24, 270, 271, 275, 277, 280, 281, 287, 291, 295,298, 319, 325, 335, 337, 341, 344, 356, 360, 371, 375, 376,388, 390, 401, 407: n = A,T,C or G
atccaggggtncccggtngctgcngggaaacctccagccttgttcttcaaaccactcagctcatgtgttttgcgctgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggggggnnaacngnaannaaaatntttntgangtngggtctataagcacccttgangggatntgttaaaagngncatnaangggggattctcntttngcaaaaaaatntaannatcaatttatananctttatttttnactttnt

SEQ ID NO: 666 - DNA, 635 bp, Homo sapiens
  misc_feature 7, 503, 540, 564, 577, 581, 616, 635: n = A,T,C or G
ctgaagnacaagggtcaggcaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaaccttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttanctctcgaatgtcattggaatcttcacctcacagtggngttgaaactgctatagcctaagcnggctgtttactgntttncattagcaggtgctcaccatgtctttggggtgggnggggggagaaagaaagaan

SEQ ID NO: 667 - DNA, 388 bp, Homo sapiens
gaaggtgatataaaatgactgtcatcatttggagtgtgcagtacagttacttcatgttcctcaggtttagaacaatttcccctgtaagttctcacacagataggcagaaatcataactaattttggttaatcactatggcagccgttgaagaatttaagagaacctgccagtaagatttggaataagattctatattattgcatccacagaaaagaatgtactgatatactataaactctaggagaaaacttaattgaaatagtgttattaagtgttgaaagtaccataaaaatataagggaaaataagctttcctagaatttttcagtgttctagtttttaaacagtgatgttttttattaacctatttcatccattcaaagacagg

SEQ ID NO: 668 - DNA, 498 bp, Homo sapiens
  misc_feature 417, 470, 484: n = A,T,C or G
tgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttattcgtttaaaaagatttaaaaatcattgcactttggtcagaaaaataataaatatatcttatgaatgtttgattcccttccttgctatttttattcagtagatttttgtttggcatcatgttgaagcaccgaaagataaatgatttttaaaaggctatagagtccaaaggaatgttcttttacaccaattcttcctttaaaaatntctgaggaatttgttttcgccttacttttttttcttctgtcacaatgctaagnggtatccgaggttnttaatatgagattt

SEQ ID NO: 669 - DNA, 622 bp, Homo sapiens
ccttagccaaagaatgcagtggagccttcccccttcaactgcattgtgaatgaataccaattaacagcataaaaattaatagtcccatatcagatctggaaggggtttctggggctgtctgatgtccctatcctgttgtagtgaacacaatagcagaaaattctttctgggtccatctgctataaagtcttggtaaaacagcattactatgaagaggatgaactcacctaccttcagatggaggaaaagtgaaaaggacttaggctttagtcctccatgacttttcttaagcactacctacctgtaataagctgagtgcaaaaggatgccgaagaaaatctgcacccagaagctgttagaaagcactgcagagaacagggtatgaagaaaataaagagttcttaataaacccttaagattctttgttcaaggtaaccttgccaaaagggcagagtaggtggcaaagagttgcttttaatctagctctacactgcatttgaaaataaaatttgcccattttgaatatattgtttataattaaatgtgctttttacactgcaggtcaatataaaaactggttagtaaatttccagcgagcatttatgttcatttgctcacagca

SEQ ID NO: 670 - DNA, 477 bp, Homo sapiens
ttgggccctctagatgcatgctcgagcggccgccagtgtgatggatatctgcagaattcgcccttgccgcccgggcaggtgatggatgaggagcaaaaactttatacggatgatgaagatgatatctacaaggctaataacattgcctatgaagatgtggtcgggggagaagactggaacccagtagaggagaaaatagagagtcaaacccaggaagaggtgagagacagcaaagagaatatagaaaaaaatgaacaaatcaacgatgagatgaaacgctcagggcagcttggcatccaggaagaagatcttcggaaagagagtaaagaccaactctcagatgatgtctccaaagtaattgcctatttgaaaaggttagtaaatgctgcaggaagtgggaggttacagaatgggcaaaatggggaaagggccaccaggctttttgagaaacctcttgattctcagtctatttatcag

SEQ ID NO: 671 - DNA, 127 bp, Homo sapiens
gtgtgtgtgtctacttgggcgtgtttaacgtgtgcgtttgtgtctgcgtgtgcatgtgtctgtgtgtgcgcgtgtatttcagtttgggttgccggatcccatatgattgcgtgcctgtgtacctgag

SEQ ID NO: 672 - DNA, 400 bp, Homo sapiens
gggtctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactgg

SEQ ID NO: 673 - DNA, 600 bp, Homo sapiens
  misc_feature 528, 590, 600: n = A,T,C or G
ctggcgttgctcattagtgaatgtatgacagcaggatgtgaggggatgcccaggagtcagtgttagcattgtcatctgagatcactgctattaatatcatccattaatttattagtgagcttcactatatgcagactgggagataaggagaaaatctgtcacattctctctagctaatcagatcagctaccaattaatgagattctgaatgaaatatcaatatgtgtttttctaatttggacctaggacagagctgttgcttgtcatagagaaaaacaataatgcttaaacatagcacattataattaaagcaggtttctcacatacttttcattttatcctttggataattttgtgaggaacgcaggacaccaacttccctttcatagatacaatccccatgctattgatgaaagtgtttttgaatgaagccatacaacaaataactgatcaaagtggcattacaccaaaatttcttagtaggactcctgcatagaatgtttagatagacgtgaaaagtttgttcangaggaccagcaagagagaaactgggttctttgggagggtttcggtgctacatttataccctncatcagagtn

SEQ ID NO: 674 - DNA, 140 bp, Homo sapiens
ggtggttggtgtaaatgagtgaggcaggagtccgaggaggttagttgtggcaataaaaatgattaaggatactagtataagagatcaggttcgtcctttagtgttgtgtatggctatcatttgttttgaggttagtttga

SEQ ID NO: 675 - DNA, 245 bp, Homo sapiens
gttgggtggttggtgtaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattagtcggttgttgatgagatatttggaggtggggatcaatagagggggaaatagaatgatcagtactgcggcgggtagg

SEQ ID NO: 676 - DNA, 621 bp, Homo sapiens
  misc_feature 13, 21: n = A,T,C or G
ctgtccccagggnaaatagtngaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggcgtggggaagggtgaatggttttgggaataattcagtgcacacctggggg

SEQ ID NO: 677 - DNA, 210 bp, Homo sapiens
  misc_feature 10: n = A,T,C or G
tttacataanatattatcagcatttaccatctcacttctaggaatactagtatatcgctcacacctcatatcctccctactatgcctagaaggaataatactatcactgttcattatagctactctcataaccctcaacacccactccctcttagccaatattgtgcctattgccatactagtctttgccgcctgcgaagcagcggtagg

SEQ ID NO: 678 - DNA, 383 bp, Homo sapiens
  misc_feature 86, 119, 120, 139, 140, 148, 162, 167, 175, 184, 222, 227,263, 270, 282, 327, 379: n = A,T,C or G
gtaggagtcaggtagttagggttaacgagggtggtaaggatggggggaattagggaagtcagggttagggtggttatagtagtgtncatggttattaggaaaatgagtagatatttgannaactgattaatgtttgggnntgagtttntatatcacagccanaattntatgatgnaccatgtancgaacaatgctacagggatgaatattatggagaagtantctantttgaagcttagggagagctgggttgtttgggttgnggctcantgtcagttccanataataacttcttggtctaggcacatgaatattgttgtggggaanagactgataataaaggtggatgcgacaatggattttacataatgggggtatnagtt

SEQ ID NO: 679 - DNA, 371 bp, Homo sapiens
aaaatgaaaatattgacaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaagg

SEQ ID NO: 680 - DNA, 176 bp, Homo sapiens
cctaggattgtgggggcaatgaatgaagcgaacagattttcgttcattttggttctcagggtttgttataattttttatttttatgggctttggtgagggaggtaagtggtagtttgtgtttaatatttttagttgggtgatgaggaatagtgtaaggagtatgggggtaattatg

SEQ ID NO: 681 - DNA, 152 bp, Homo sapiens
ctggagatggatatgagactagtcaagatgtgaatgctaattggagagaaatataattttaggaagatgcacattgatgtggggttttgatgtgtctgattttgactactcaagctctgtttacagaagaaaattgaatggcgagggtgtgg

SEQ ID NO: 682 - DNA, 141 bp, Homo sapiens
ccagtgcttgcttgccgtggtttagtgattgggtgttagaaataaaaactcaggtctatttcttaccagtcagtaacaatttttagagaatgtacttggtatataatatatggacttcaggaactttgttggggtgggggg

SEQ ID NO: 683 - DNA, 308 bp, Homo sapiens
ccagcaatggtacagagtgagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtatcaaaaaactagaacaccagctcctttataatgcatgtcag

SEQ ID NO: 684 - DNA, 277 bp, Homo sapiens
tggtattaggattaggatgtgtgaagtatagtacggatgagaaggttggggaacagctaaataggttgttgttgatttggttaaaaaatagtagggggatgatgctaataattaggctgtgggtggttgtgttgattcaaattatgtgttttttggagagtcatgtcagtggtagtaatataattgttgggacgattagttttagcattggagtaggtttaggttatgtacgtagtctaggccatatgtgttggagattgagactagtagggctagg

SEQ ID NO: 685 - DNA, 457 bp, Homo sapiens
  misc_feature 10: n = A,T,C or G
ctgtggcgtnccctacttctcccaaacctcgcaactccctcccaggacagtcagtgccaaagaaacaggtcgctgaaaactaaaatgtccacatccctaactggcaacccacatcaaccccaaaaggttgaagaatcatctaagatatttcagatgctctatgaagaaattcactttaacacttataactgtaagactttgcatacattacaacagtgcattagtgatacaagttgtaaaatacgtttccattcctttggattttgcatatgatggttttgcatcagtcactgcaggtagattgagcaagctttttgtgtttgtttttttaaacatgcattcaactagatatgattcagaatagattaatactccctttttatcactacagttagctaaaaaattgccaggcagtccacaaaacagaatttgctttaagaccaacccacagagtcag

SEQ ID NO: 686 - DNA, 234 bp, Homo sapiens
  misc_feature 1: n = A,T,C or G
ntggatttataaaatagttgcaatgacaaaagaagtatgttttgacagtaaaaaaaagacattatggacaaaatatgcaaaatgtgcaaagaaaaaataaatttgcattagaaaggtgggcatttgatctctgagccctgtgccatgtaacattgccatgttctttcactgttgtttgaatgttgtaccccagcccttgactctggacttaaggcaagctatgactggctttgg

SEQ ID NO: 687 - DNA, 315 bp, Homo sapiens
  misc_feature 1, 2, 190: n = A,T,C or G
nngtctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgngtgtcatatcctattttgtgatgatggggattctgaccatttatacctcatataaggagaagagcatctttctcgtggcccacaggaaagatcctacaggaatggatcctgatgatatttggcag

SEQ ID NO: 688 - DNA, 522 bp, Homo sapiens
  misc_feature 31, 32, 387: n = A,T,C or G
ctgaattagaggaggagaaaagaagccattnnggagtactttaattgtttagatgtgagaggctgaatgtttgggttaagatgttagttgtcagaatcatgagaaaaggttttaagcaaggggcatttctaattctaaaaataacaactactgttatttattgagcactatctttttgttgggtactgtctaaagtacttgatttattttttaaaaccttacaaaaaacttacaaggtaggtactgaaagattcagtaatttgttcaaagtcacacagcaaataagcaacagactctggatttgaaccaggcaatcctagagcctgtactgttagtaattatactttagcacctgtcaagaattcctgttgagtgtcaagaagcaancaccaagttaggatttaaagcaaacatgattgaagaatactgtggtgtggttgacagtagtgcctaagtctgttttcagagtgaaaaatgacaaattagattttaagtatggtttggagataatatcaggacagt

SEQ ID NO: 689 - DNA, 158 bp, Homo sapiens
  misc_feature 11, 13, 15, 34, 51: n = A,T,C or G
tctcaacttantntnatacccacacccacccaanaacagggtttgttaggnattgtttgcattaataaattaaagctccatagggtcttctcgtcttgctgtgtcatgcccgcctcttcacgggcaggtcaatttcactggttaaaagtaagagacag

SEQ ID NO: 690 - DNA, 300 bp, Homo sapiens
  misc_feature 33, 261: n = A,T,C or G
tagaactcgtatttttaaacttctattctctanccttttccactacattatgacacaagaccctgcagaaagtcgtctggaaaatatcagaccatctcttacttgtcccatccaatcttacatcgaattatatgcacccttaaaaagttatttggagttttaaaaaactctattagcccaaattacctgaaataaactcctggcttgttcccctaatgtttataaaaaattgattgaaaatattcattttaaaaatgaagntcttgaatttatttaaattactgtcttgcagtgagttgg

SEQ ID NO: 691 - DNA, 305 bp, Homo sapiens
ctgttcagaaagctcattggacctggttttgaaaataaaacaaagttaaaaccctgggaggagttattgtgcagtgtggagtactcaggctttcttataaagaaaaaaaaagttatctggtaccaaagtgtgcaacctacagaccctcaggtactgccctgtgacttctctgtatgacatcacaaggctgccaagtgcctgtttttctagaactaggagttggtgaggtttggctagtgctgaaaccatgcataggattggtttactaaattaaaaccttattacgtacgtcctccaaaagacag

SEQ ID NO: 692 - DNA, 582 bp, Homo sapiens
caggaaatggataaccattttaactgtattttttgcagcccgtaccttcttgggaatacaattgtctaactttttatttttggtctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaggtgagcgaccttatctctgtgcttcgtgaagctaatcaagcaattaatcccaagttgcttcagttggtcgaagacagaggtgcaggtaaggatgactgataggaaatgttggtagttacgagtcacatcgttgtctacaaatccatttaaatggtattggagggtgagtaaaaccttgaatgtgaaaacttaagctgaaaaattgtaaaaacatttcacgcctaccatgaatagatctgtttctttctgtccacaatgatttgtgtcatagacataattgatcaatttgcaattg

SEQ ID NO: 693 - DNA, 275 bp, Homo sapiens
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttg

SEQ ID NO: 694 - DNA, 397 bp, Homo sapiens
  misc_feature 1: n = A,T,C or G
nggtctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccag

SEQ ID NO: 695 - DNA, 609 bp, Homo sapiens
  misc_feature 29, 96, 165, 236, 248, 312, 314, 334, 352, 359, 413, 414,472, 525, 547, 583, 609: n = A,T,C or G
ctgagcttccatttgtcagctagcactgnggtagtcaaccatgcgaatgaggctattttggacctcatgattgtccagtgcctgggctgataccgngggaaacgaaattttgtggctgcccacaaaatcatggaaaataatgattttttagaaaacctccactgntttgttgtgcagcaataaataactgaaacaccaatccaaaaaacttataaagctataacaattaaaacagnataataatagtnccgggatacaaaaatggtcaaattgaagaggatacaaagcctcaaagcagtcctcactcataananccttgttgtatcactaaaanggcattaaaattgagaanaaggaanaactagtggattaattaataaatgagaagtatccataaggaaaaattaaaattnnattcttgcttcacattatgaaaaaatacaaacaacagattgattaaagacttaaatgngatcaacaaaatgttaaaactgtgataagaacatttaagaaaatagttctatnaccctgggataaaacattttcntccaaggcattaaagtgttaaatgaaaagactgatncatttattcattagaatttaaattcn

SEQ ID NO: 696 - DNA, 300 bp, Homo sapiens
ctgcaaaataagcgtgctaaattaaattgtcttaaggtttttccacttcattttgtgactttgtgtggttcgaatttctcagtattttaaccagtgtgttgatgttaaagtcaaaggctgcagtatgtctatattcttgctgtactcattggtagtttcagtatatgtaatgtgagtttaaatagtgaaattgtatctcatattaacatttcaaatgctcatattgaaaatggaaaatagtaaacacgggaattgattttattctggttgtctataatacttcattttaaatgtaaatgg

SEQ ID NO: 697 - DNA, 391 bp, Homo sapiens
  misc_feature 1, 2, 10, 16, 23, 315, 350: n = A,T,C or G
nngtcatgtntgatgnatctgancaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagnaaggcatggttgtggttaatctggtttatttttgntccacaagttaaataaatcataaaacttgaacaaaaaaaaa

SEQ ID NO: 698 - DNA, 536 bp, Homo sapiens
  misc_feature 508, 523: n = A,T,C or G
ctgagcatacagcaataaaaataacataatttttatgtgtacaatatttatggaatacgttactggaacagataaataatttagttaataacatgacaaagaacagaaattgtatacactatacagcatagtaatagaataatgaatgattaaagttattaatattaggtagaaaatgaagggtatctttgagagcagaactcaaggaagcaagcaatttgccttatgaggaaagagttacctgtggataaaggagaaactgaaaaatttacaagtcaagactttttgagcaaagacaaaaatatgactatgagtcaccaattcagtacagtgaaaaaaaagttgaagagatatcttggaagtaaaccatgttgtggaagagcagggttttgataatcatgggattattctgaatgaattttaaatgcgataggaatatatgagataatttcaccagagaataatatgatcatgtttgcatttcaaaggggtgtatctggtgcactgngtagaataaataggntatgtgagcaagt

SEQ ID NO: 699 - DNA, 419 bp, Homo sapiens
  misc_feature 1: n = A,T,C or G
ngtccacctgagggcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccag

SEQ ID NO: 700 - DNA, 336 bp, Homo sapiens
ccacttattgtccttaaaaatccatactgatacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaagg

SEQ ID NO: 701 - DNA, 418 bp, Homo sapiens
ccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaagg

SEQ ID NO: 702 - DNA, 261 bp, Homo sapiens
  misc_feature 104, 178, 184, 240: n = A,T,C or G
gggcctgttgtgggggtgggggaagcagggaggggaacagctaaataggttgctgttgatttggttaaaaaatagtagggggatgatgctaataattaggctgngggtggttgtgttgattcaaattatgtgttttttggagagtcatgtcagtggtagaaatataattgttgggacnattagntttagcattggagtaggtttaggttatgtacgtagtctaggccatatgtgttgganattgagactagtagggctagg

SEQ ID NO: 703 - DNA, 261 bp, Homo sapiens
  misc_feature 40, 104, 178, 184, 220, 246: n = A,T,C or G
gggcctgttgtgggggtgggggaagcagggaggggaacanctaaataggttgctgttgatttggttaaaaaatagtagggggatgatgctaataattaggctgngggtggttgtgttgattcaaattatgtgttttttggagagtcatgtcagtggtagtaatataattgttgggacnattagntttagcattggagtaggtttaggttatgtacgtagnctaggccatatgtgttggagattganactagtagggctagg

SEQ ID NO: 704 - DNA, 381 bp, Homo sapiens
  misc_feature 1, 4: n = A,T,C or G
ngtntgaattctattaaagatacaaagaggagctggtaccatttcttctgaaactattacaaacaactgaaaaggtggaatttctccctaattcattttaggaggccagcattatactgataccaaaacctggcagaggtacaataataaaaggaaacttcaagtcagtatcactgatgaacaccaatgtgaaaatcctcaataaaatactggcaaactgaattcagcagcacatcaaaaagctaatccaccacaatcaagtcagcttcatccctgcgatgcaagtctggttcaacatatgcaaatcaataaatacaattcatcagataaacagagctaaagacaaaattcacatgattttctcaatagatgcagaaaagg

SEQ ID NO: 705 - DNA, 477 bp, Homo sapiens
ctgaaccctcgtggagccattcatacaggtccctaattaaggaacaagtgattatgctacctttgcacggttagggtaccgcggccgttaaacatgtgtcactgggcaggcggtgcctctaatactggtgatgctagaggtgatgtttttggtaaacaggcggggtaagatttgccgagttccttttactttttttaacctttccttatgagcatgcctgtgttgggttgacagtgagggtaataatgacttgttggtgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttagg

SEQ ID NO: 706 - DNA, 266 bp, Homo sapiens
  misc_feature 100, 115, 157: n = A,T,C or G
ccatggctaggtttatagatagttgggtggttggtgtaaatgagtgaggcaggagtccgaggaggttagttgtggcaataaaaatgattaaggatactantataagagatcaggntcgtcctttagtgttgtgtatggctatcatttgttttgaggntagtttgattagtcattgttgggtggtaattagtcggttgttgatgagatatttggaggtggggatcaatagagggggaaatagaatgatcagtactgcggcgggtagg

SEQ ID NO: 707 - DNA, 358 bp, Homo sapiens
  misc_feature 131: n = A,T,C or G
ccatcagagaaatgcaaatcaaaaccacaatgagataccatctcacaccagttagaatggcaatcattaaaaagtcaggaaacaacaggtgctggagaggatgtggagaaataggaacacttttacaccgntggtgggactgtaaactagttcaaccattgtggaagtcagtgtggcgattcctcaaggatctagaactagaaataccatttgacccagccggccaatattcaacattcttaaaggaaagaattttcaacccagaatttcatatccagccaaactaagcttcgttagtgaaggagaaataaaatactttacagacaagcaaatactgagagattttgtcaccaccagg

SEQ ID NO: 708 - DNA, 491 bp, Homo sapiens
  misc_feature 12, 479: n = A,T,C or G
cctactatgggngttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggtagtaagggnggagtgggtttg

SEQ ID NO: 709 - DNA, 460 bp, Homo sapiens
  misc_feature 1, 197, 216, 231, 313, 389, 411: n = A,T,C or G
nggttttttttgtagagcaaataatttatgcaaaatatgttacaaaatctgggatgctaaatagttgacacaagtactgtgtttgacatttagtttcatttgaattagtaatagaatttgctccttccaacatttacatcttttttctttctgactttatatattttcaataaaaatttgctccacagtttttaagntcattcttcttgaatccgnttttacatttgctgngacaaacctgcataaaactagattttatagatataacttctttggaagagataaaaattcaaaagtttgacattgctttcanttattcttttcttcattgttttgattggcccctgttagattgatgtattgccaatctacttttgatggcatgaatntaaaatgacaacataaaaagcncttctagtgcaacagtaattgaaacttgcagttttccattaaaaaaaaa

SEQ ID NO: 710 - DNA, 542 bp, Homo sapiens
  misc_feature 275, 507: n = A,T,C or G
ctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcatagatcctactatgcgattaacactgtttatgtatatggacaagagaaatacttgttgttgcatgatatctcagaatcggaatttctaactgaagctgaaatcatttgngatgttgtatgcctggtatataatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtnaggatatctttgttaaattgacaacaatggacctg

SEQ ID NO: 711 - DNA, 394 bp, Homo sapiens
  misc_feature 184, 299: n = A,T,C or G
caaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactanaaataactttgcaaggagagccaaagctaagacccccgaaaccagacgagctacctaagaacagctaaaagagcacacccgtctatgtagcaaaatagtgggaagatttataggnagaggcgacaaacctaccgagcctggtgatagctggttgtccaagatagaatcttagttcaactttaaatttgcccacagaaccctctaaatccc

SEQ ID NO: 712 - DNA, 552 bp, Homo sapiens
  misc_feature 11, 133, 329, 345, 421, 518: n = A,T,C or G
gaggtctgtanaatgccaggctcaaatttgtctttataatttaataccagaaatctttcccttgtgatgtttctttctttctggattgcctctatagcaggggatagcgggggaggataaggcacatctttgntgtactgagaaatttgaccacgcaggatgatgtggctgttctcattcatctgcacagagaaaaataatgataaaatatccctttcctatgtttactgattttatggctgccataatggaagcctccttgactatttaatcctttctgtcaactaggttcgattttttttttaatttacctgttagaggtatttaanaattttaactagctanaaataattacattccaaaggaacaccaaggcaaataaatggttggtaatcagcaaaagaattacattagttgttgntgctacttattagggggagaactgtttttttttaaatttaaacaatttaataatctcaactgcaaataattttagatgcagcaaaggactatgtagncgttaatacctcatgttgatattttcataatatt

SEQ ID NO: 713 - DNA, 518 bp, Homo sapiens
  misc_feature 133, 148, 188, 209, 246, 248, 263, 306, 316, 339, 371, 430,469: n = A,T,C or G
ccaaaaactggaagcagctcactaaacaaacagtggcatacccatagaactgcatacttctcagcagtatgaaagaatgagctacttatataagcatcattgataaacctcaaaaaaaaaatgccacatgaanaaacccaaagggganaaacataaaaactttatatgtcagtcatataaaattctanaaaatgcaaactaatccatcntaaaggaaagtaaatcaacagttgtctggaggaccananagagcaggaggaganagattattaaaggggttaaagtaaatttgggagtgcccttccntttttaaatnctatgaaaatgaaagtaaaggcncatgcatgttgtaaactaatagtaacaaacanaatgggttggagtggggtgttgtctggggacatcattacaaaatgtaagccagtttatntaaattttgaaaagaccgtggactctgatctgactgatnaatgttggaagagataagtgtgctgcaaatgggggaattaataaaacag

SEQ ID NO: 714 - DNA, 281 bp, Homo sapiens
ccaattgatttgatggtaagggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttgtagacc

SEQ ID NO: 715 - DNA, 443 bp, Homo sapiens
cttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcccgacatggagtctgatatacgttcatgggaattgtttctttctaatgttacaaaagaaattgagaaagcaaagtctcagtttgaagaacaaattaaggcaattaaaaatggttcccggctcagtgaactttctaaagtgcagatttctgagctttcatttcctgcctgtaacacggttcatcccgagttactccctgagtcttcaggccacgatgg

SEQ ID NO: 716 - DNA, 639 bp, Homo sapiens
  misc_feature 6, 516, 532, 553, 602, 617, 620: n = A,T,C or G
ccaaanaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacnaaatggaagaatttangattctaaatgaccaaaacanagcattaaaatcagaagttcagaagctgcagactcttgtttctgcacangcctaataaggatgntgnggaacaaatggaaaaattg

SEQ ID NO: 717 - DNA, 473 bp, Homo sapiens
  misc_feature 1, 2, 102, 148, 157, 187, 290: n = A,T,C or G
nntgaggctactgctgttttattacaacattacctcttgtttttataaagtgtaccaagatttaaattgataactttattttacttgaaaaaaaaaagtttnttttatcaccagtgttacagttgtcttctgtttctttttgttttgntttatttgntttcctttttagccaaagagtgaacagaanattttcttattttggtggctattcattttacttttaaaagtgattggtggattttagactaattatgggggaatttgccaccaaaataaaaaatatgtaaagngtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcactgtctgcatttggttcctggttgg

SEQ ID NO: 718 - DNA, 207 bp, Homo sapiens
ggtaaatgctagtataatatttaccatctcacttctaggaatactagtatatcgctcacacctcatatcctccctactatgcctagaaggaataatactatcactgttcattatagctactctcataaccctcaacacccactccctcttagccaatattgtgcctattgccatactagtctttgccgcctgcgaagcagcggtagg

SEQ ID NO: 719 - DNA, 255 bp, Homo sapiens
  misc_feature 214: n = A,T,C or G
cctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagncccaccctcacacgattctttacctttcacttcatcttgcc

SEQ ID NO: 720 - DNA, 455 bp, Homo sapiens
  misc_feature 154, 346, 349, 366, 444: n = A,T,C or G
ccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaanaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagctccatagaaaaggcgtgcagtactaagggaacaatccatgtgattaatgnttncattatgttcatgtaanaagccccttatttttagccataattttgcatactgaaaatccaataatcagaaaagtaattttgccacattatttatnaaaaatgttcc

SEQ ID NO: 721 - DNA, 530 bp, Homo sapiens
  misc_feature 134, 390: n = A,T,C or G
ccagtgcttgctgccgtggtttagtgattgggtgttagaaataaaaactcaggtctatttcttaccagtcagtaacaatttttagagaatgtacttggtatataatatatggacttcaggaactttattggggnggggggttaattttgccttaccctgttcactttcagatgattaggcttttgcactttagaatgagaaacttgtgacgttagtgtgttcttactagctttaatttgtatgtagcaatgaattgtgaatcttagtgcagtgggtttttttaaaaaactcaaaaagctgggaattaagtggtttcagtaataatgctataccgaggtgcttgcattgtatttcataattttgttacaaaccaaaattatttttaatganaacggtcttgggttcagaggtgtgatgccagaatgtattttcgtactgttaggcccttggaacagataccggtgctttcttgaaagatgaaagaaatgcaatgggtgctcttcatgcaaggttgcaaacctaccaagaat

SEQ ID NO: 722 - DNA, 242 bp, Homo sapiens
  misc_feature 29, 35, 55, 192: n = A,T,C or G
ccaagggtcatgatggcaggagtaatcanaggtgntcttgtgttgtgataagggnggagaggttaaaggagccacttattagtaatgttgatagtagaatgatggctagggtgacttcatatgagattgtttgggctactgctcgcagtgcgccgatcagggcgtagtttgagtttgatgctcatcctgatnagaggattgagtaaacggctaggctagaggtggctagaataaataggagg

SEQ ID NO: 723 - DNA, 472 bp, Homo sapiens
  misc_feature 191, 266, 460: n = A,T,C or G
cctactatgggtgttaaattttttactctctctacaaggttttttcctagtgtccaaagagccgttcctctttggactaacagttaaatttacaaggggatttagagggttctgtgggcaaatttaaagttgaactaagattctatcttggacaaccagctatcaccaggctcggtaggtttgtcgcctcnacctataaatcttcccactattttgctacatagacgggtgtgctcttttagctgttcttaggtagctcgtctggnttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaangttgtctggtag

SEQ ID NO: 724 - DNA, 292 bp, Homo sapiens
  misc_feature 1, 26, 73, 177, 215, 256, 274, 276: n = A,T,C or G
nccaccactgcagccctacatacagntgaaaaaaaattccattctgttaacatttgttttataagttttcacncaatacacaaaaaacccctctgcacttcttgtaaagaacaaaaaagatacacaacagttaagcgtaaagatcacaggcaatagcattcaaacatggatgtgggnagagaaaggagtacctggcatgagtacctgcttagttngactgaatccttgatttttaatttggcttttcatgggccgntcacaacaccaacgctgngngaggtatggtagtcag

SEQ ID NO: 725 - DNA, 122 bp, Homo sapiens
  misc_feature 35, 61, 86, 88, 91, 114: n = A,T,C or G
atagaaagggcatacccaaaatgttactgaaaatntaatacaaattccaagattcaccaangaagtaacaaaaacctggcctgcangnggncccctatcccgtggctccatggntgatgtgg

SEQ ID NO: 726 - DNA, 477 bp, Homo sapiens
  misc_feature 266: n = A,T,C or G
ctgaaccctcgtggagccattcatacaggtccctaattaaggaacaagtgattatgctacctttgcacggttagggtaccgcggccgttaaacatgtgtcactgggcaggcggtgcctctaatactggtgatgctagaggtgatgtttttggtaaacaggcggggtaagatttgccgagttccttttactttttttaacctttccttatgagcatgcctgtgttgggttgacagtgagggtaataatgacttgttggtgattgtanatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggcggctgcttttagg

SEQ ID NO: 727 - DNA, 416 bp, Homo sapiens
cctgtctttgaatggatgaaataggttaataaaaaacatcactgtttaaaaactagaacactgaaaaattctaggaaagcttattttcccttatatttttatggtactttcaacacttaataacactatttcaattaagttttctcctagagtttatagtatatcagtacattcttttctgtggatgcaataatatagaatcttattccaaatcttactggcaggttctcttaaattcttcaacggctgccatagtgattaaccaaaattagttatgatttctgcctatctgtgtgagaacttacaggggaaattgttctaaacctgaggaacatgaagtaactgtactgcacactccaaatgatgacagtcattttatatcaccttcaattacccaacagcttttaatagtctgg

SEQ ID NO: 728 - DNA, 416 bp, Homo sapiens
  misc_feature 411: n = A,T,C or G
cctgtctttgaatggatgaaataggttaataaaaaacatcactgtttaaaaactagaacactgaaaaattctaggaaagcttattttcccttatatttttatggtactttcaacacttaataacactatttcaattaagttttctcctagagtttatagtatatcagtacattcttttctgtggatgcaataatatagaatcttattccaaatcttactggcaggttctcttaaattcttcaacggctgccatagtgattaaccaaaattagttatgatttctgcctatctgtgtgagaacttacaggggaaattgttctaaacctgaggaacatgaagtaactgtactgcacactccaaatgatgacagtcattttatatcaccttcaattacccaacagcttttaatantctgg

SEQ ID NO: 729 - DNA, 564 bp, Homo sapiens
  misc_feature 399, 439, 463: n = A,T,C or G
ctgtgagtagaggagtcttcccgagagtagcagttgttgatccaaatgattgaagccttcaggtaagggaataactgctgcaggaattctttcttgaagaatttaagctgtttggtaagaattctgtaactacatacctttgaaacactattcacattcaaataaacgcttgttttctagccaggcacaggctcaattagtttttcaaactctagccaaggcagtatttcatttgggaaatcatgcaacagaactgctcaattcttaacttctcctgctgttaacatttacacttagactgccagcaacagttaacttaaattttggtctcaagggaacaaaaaaaaattgcattcagaatttaatatagtattttaaaactaattttagcctgtaagncattatgagcaatagtaacttttatacctcctcatcttgnctgataatatattctatatgctgncaatctgattatatagtctatatgctagaagttgctgattttcattctgccaccaaaaaaaactgtccttttttttttatgggggaaaaagggaatttaaa

SEQ ID NO: 730 - DNA, 310 bp, Homo sapiens
ccatttttatttcttcttcagagaagtgtttatttaggtctgttgcccattttacaattaggccatatgttttcttgctgttgagttgtatgtgtgtttgtataaattttgcatattaaccccttatcacacgtatgttttttaaaataaattttgcttattaatcttttatcagatgtatggtttccaaatatattcttccgatccatggattctcttttttgttatgattgtttctttgctcttcggaagctttttgttttgttttgttatttgttttactttgatatagtcccatttattgtttttg

SEQ ID NO: 731 - DNA, 467 bp, Homo sapiens
  misc_feature 1, 260, 276, 334, 388, 392, 407: n = A,T,C or G
ngacaaccttagccaaaccatttacccaaataaagtataggcgatagaaattgaaacctggcgcaatagatatagtaccgcaagggaaagatgaaaaattataaccaagcataataaagcaaggactaacccctataccttctgcataatgaattaactagaaataactttgcaaggagagccaaagctaagacccccgaaaccagacgagctacctaagaacagctaaaagagcacacccgtctatgtagcaaaatagngggaagatttataggnagaggcgacaaacctaccgagcctggtgatagctggttgtccaagatagaatcttagntcaactttaaatttgcccacagaaccctctaaatccccttgtaaatttaactgntagnccaaagaggaacagntctttggacactaggaaaaaaccttgtagagagagtaaaaaatttaacacccatagtagg

SEQ ID NO: 732 - DNA, 492 bp, Homo sapiens
  misc_feature 266, 343, 364, 483: n = A,T,C or G
cctactatgggtgttaaattttttactctctctacaaggttttttcctagtgtccaaagagctgttcctctttggactaacagctaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggnttcgggggtcttagctttggctctccttgcaaagttatttctagttaattcattatgcagaaggtataggggttagnccttgctatattatgcttggntataatttttcatctttcccttgcggtactatatctattgcgccaggtttcaatttctatcgcctatactttatttgggtaaatggtttggctaaggttgtctggtagtgaggcggagngggtttggg

SEQ ID NO: 733 - DNA, 562 bp, Homo sapiens
  misc_feature 1, 169, 400, 430, 460, 497, 513, 523, 555: n = A,T,C or G
ntgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccanatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgnttcctcctttagggaggcaatgcaaagagngtggacatcttctaatcttgaggaacagtngttgatttcccttgaaggagcttacatattgactgtntttcacaataacctgnttgccccagntcaatccctcattttaatacttaatgttggtnctgggct

SEQ ID NO: 734 - DNA, 265 bp, Homo sapiens
  misc_feature 1: n = A,T,C or G
nggtccagaacaagagaaataactgcagaaaacacatatggttggaaaccatgcgcttgtgactttttctgtagcctatgggagtggacagagtgggtaacccaagatgtttttaagactgactggactaagaatggcgtacttatagccaactacttcccccctaatgtgactgaagggattcataatgatcacaattagcattacggttaagtattttagggttgacgtctaagctcacacttgaaaggtatttatctaatgg

SEQ ID NO: 735 - DNA, 216 bp, Homo sapiens
atttaatacgtgctcactgctcggcacgcgctgaagctacagttaacaatcagtgagcacatattaaatgataaaataatgctgatggtaaacattcataacagcagagtaagattttggcagttttgtgtctcggtaacataactgtaaccttagatgaacacctatcccttcatgatctgactttagaggcaaggagtttgtaacatctaatgg

SEQ ID NO: 736 - DNA, 285 bp, Homo sapiens
  misc_feature 13, 177: n = A,T,C or G
ctgaaaggcaacntggagactagttagtctagtcccctcatattataaattggtatgctgaggccaggcagtaaattgctatggagctctccaatttaaggccagtttgactccaagggtagggcttctagtaaaattttgtgattaaattggaaactctaatttatttttctatgngtttttggtacctaatcctcataagcaagccatatttcaaggctgatcaatgaaaacaccaaataccaaagcttcctttcccttccaaatttactgaccctttgtcag

SEQ ID NO: 737 - DNA, 509 bp, Homo sapiens
  misc_feature 4, 13, 303, 347, 419, 446, 473, 483, 489, 503: n = A,T,C or G
agangaagaagangaagattaagggaaaagtacatcggtcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgngaggagctaatccctgaatatctgaacttcattagaggggtggnagactcggaggatctccctctaaacatatcccgtgagatgttgcaacaaagcaaaattttgaaagttatcangaagaatttgggtcaaaaaatgcttanaactctttactgaactggcggaagatnaagagaactncaaganattctatgagcagntctctt

SEQ ID NO: 738 - DNA, 97 bp, Homo sapiens
cagtgaattgaatacgactcctatagggcgaattgggccctctagatgcatgctcgagcggccgccagtgtgatggatatctgcagaattcgccctt

SEQ ID NO: 739 - DNA, 209 bp, Homo sapiens
  misc_feature 4: n = A,T,C or G
ccgncagtgtgatggatatctgcagaattcgcccttagcggcccgcccgggcagggtccttatatatagtagcttagtttgaaaaaatgtgaaggactttcgtaacggaagtaattcaagatcaagagtaattaccaacttaatgtttttgcattggactttgagttaagattattttttaaatcctgaggactagcattaattgacgg

SEQ ID NO: 740 - DNA, 164 bp, Homo sapiens
ccaagctaatgggtgacactgtgaatgcaactctaatgcagcctggcgtaaatggtcctatgggcactaactttcaagttaacacaaacagaggaggtggtgtgtgggaatctggtgcagcaaactcccagagtacatcatggggaagtggaaatggcgcaaat

SEQ ID NO: 741 - DNA, 514 bp, Homo sapiens
  misc_feature 82, 438, 485, 497: n = A,T,C or G
ccagtcagaattgagatgtgctgtgagtgcaaaatacactcaaatctaagacttagtatggaagaaaaagaagataaggtgnttcattaataatcttttatattgattacatgttgaaatgatatttttaatatactgggttacataaactgttattaagattaattttgcttgtttcttttttaatatggctactagaaaattaaaaattatgttgtggttcacattatatttctgttgaacaatgtggacatagataatctacagtcattacattagccttagaatttagcatcatacttttaagcactctggggtactaacttgaactcccagaaacccataagcacactctgcatataaattattgcaaaattcattcttatctctctgaaagatatgcattttaagggtaaaaagaattcacaaaatattgantccttaacaaatgtcaattagtatatggagagagctaaaggacttcntgtagactggtncattggggaaaaacaga

SEQ ID NO: 742 - DNA, 439 bp, Homo sapiens
  misc_feature 28, 123, 144, 347, 367: n = A,T,C or G
gcaggtcctatgcatagttaataagggntataatctactcaacatggaaaatgggagcctatttgcaaacacacgagtaattaaagtaccaattctctcttagtttctttttttatagttggnttattttgcaattataaatgntaaacatccctagagatgaaagttaaaatggctgatcacagatcagtagcaaaatacaaattgacaattcaaaattataaataaaactctgttgaggatgtttaactttgagcctccaaatttaagagctaagcttggaagaaacaaatttataggttatatttccctcttaaattaaaaaacaaacttcctctggcagtagnttgtgaattcctttcattgnaatgataccatgattacaggatcaaaaatgcttaacttacttgccattctgctcacatcatcacagttgttt

SEQ ID NO: 743 - DNA, 275 bp, Homo sapiens
  misc_feature 3: n = A,T,C or G
cangacgctacttcccctatcatagaagagcttatcacctttcatgatcacgccctcatagtcattttccttatctgctccctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 744 - DNA, 295 bp, Homo sapiens
  misc_feature 5: n = A,T,C or G
ctgtncttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccactcgtttttaaataaagatgcaagtgtcagttgtagattattgggatgaagctaaatccccagaatgcagcagcag

SEQ ID NO: 745 - DNA, 477 bp, Homo sapiens
  misc_feature 434: n = A,T,C or G
cgcgttactgtacatattgctagcaggagacaactggaaatactaaacaaatactggaattcacattacagacagacgaaaccaacatggatgccacacataacttcctttgtagtttcacagagagcctatttgtggttgctcaggtggggtcatacattgcttgcagaaatggcctgatcatagctctatgaaacaatgaattcggaatgaaatcttaccatgacacctctctgtaggaaagaaatgttgcttcacgtgtgctaagttgagataataatatttcacatatttatatacagagaatcactctcaaatttaacccaagataagcaataggatttgggggtgacttgtacacatttctaacaacacttttcttttttctagaggtcactctcaaacactgatatatcactatagtttgagtgtanggattcagtaatcaaaggttgttattgcaaaagagccaggcag

SEQ ID NO: 746 - DNA, 524 bp, Homo sapiens
  misc_feature 393: n = A,T,C or G
ctgtgaaattgggttgggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagatataccagaagctaacattctgctgaattttatacgagaaaataaagaaacaaatgttctggatgatgaaattgacagttatttcaaagaatccataaatttaagtacaatagttgatgtctacacagntgaacaattaaagggaaaagctttgaagaatgaaggaaaagctgatccttcctatggcatcctttatgcctacatttccacactcaacattgatgatgaaactcaaaagtagttcgaaatagatgttccag

SEQ ID NO: 747 - DNA, 456 bp, Homo sapiens
  misc_feature 411: n = A,T,C or G
cctcagttcttgattgtggttgacggggcgtcaccatgaaggagcccatttagtataaagcttccaaccttttctcttaatcgtttctttaatcttttaaaccatcttcaagtgcataggggagtttccgatgccagaggatgaaagcaagtgctttctccaccctctcctcccagagtgaaaacaaatccttttgctgatacttgtttcaaaagcatccattgtaaagcttctcagtgacacaaaatactgagaggtaactttttatcaatcaaaccacataccccaatttaacacctttcagtgctctgaattcaactgacagactaaagggtgtttcctgtaacagtctgaaatattaagtgttttttttgttttgtttttaaatcttatttcagaaaacttcctctnggggtaggaaagtacacatgaagcagcaaagtaacgaagaaaaac

SEQ ID NO: 748 - DNA, 474 bp, Homo sapiens
  misc_feature 4, 28, 58, 207, 210, 217, 423: n = A,T,C or G
ccanaccagggaaccaaatgcagacagngaagttctctgcttcttttggctataatgngacaagaaagggatcatcttttgaagatgtttaaagaaataaagcaactttctttataaacagtcaaataatcaattaatggaataaataagtactaacccacattttaaccactctgtaatcactacactttacatattttttatttnggnggcaaantcccccataattagtctaaaatccaccaatcacttttaaaagtaaaatgaatagccaccaaaataagaaaatcttctgttcactctttggctaaaaaggaaaacaaataaaacaaaacaaaaagaaacagaagacaactgtaacactggtgataaaagaaactttttttttacaagtaaaataaagttatcaatttaaatcttggncactttataaaaacaagaggtaatgttgtaataaaacagcagtagcctcag

SEQ ID NO: 749 - DNA, 355 bp, Homo sapiens
  misc_feature 8, 9, 12, 22, 242, 311, 332, 348: n = A,T,C or G
cctgggtnnagnggctgactgnaacctccacttcctgttctcaggcaatcctcctgcctcagcctccttagtagctgggactacaggagtgtgcaaccatgcccaactaatttttgtatttttaatagagacagggtttcaccatgttgatcaggttggtctccaactcctgacctcaggtgatccacctgtcccagcctcccaaagtgctgggattacaggcatgagccaccacgcccggnccaggataaagtaaaaatttgtaagcacacaaggccctttgcaacctggctcctggttactactttaancctcctgccctcccaaatgtnctcactgtttttctanacatacc

SEQ ID NO: 750 - DNA, 493 bp, Homo sapiens
  misc_feature 350, 364, 454: n = A,T,C or G
ccatgctggtctcgaactcctgaactcaggtgatccacccgcctcagtctcccaatagattacatatattattaatgaattgcttcctttaacaccctattcattgaattttccagtaaaccacaattactaattactcctgaaatcagaaaagaggttaaaaagattttataacagtatcctatgaaatctactactttcaagtaatagtagttgaattaccaaaacccgtcactcaagccaatgactacaattaagatatgagtaacatttcctagataaataaagtcaattaattatatttgcatctgggaaatagagaaagtacatataagccatgattttgaagncaaaagagagagantatttgccaaggaggggtgagttatagtatgtaattataacatacagaagctttttgtatgctggtaactaattttaatttcctacattnttatggagatttctgctattcttgtcctattttccacct

SEQ ID NO: 751 - DNA, 364 bp, Homo sapiens
  misc_feature 11, 34, 211, 360, 362: n = A,T,C or G
cgaggtctggnaaggtcaccaagtctgcccaganagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgnggaccactttggttttcttttttgcgtgtggcagttttaagttattagtttttaaaatcagtactttttaatggaaacaacttgaccaaaaatttgtcacagaattttgagacccattaaaaaagttaaatgagataaaaaaaaaaaancntg

SEQ ID NO: 752 - DNA, 498 bp, Homo sapiens
  misc_feature 17, 368, 395, 400, 425: n = A,T,C or G
ctggattatgggttggnattggtcatatgttagactccatacaggcatagctatgatgcagtgaatcccttagaagttacaattctcaaattacatacttcctcagatgtaacattagaactcaatatttctaacaataacataccagaaaaggctggactggcactcatctgctgactaacttgtagcctcagtaatatgacatacttgcctttaacaaattatctcaaattaactaacagaccttcagaaaatggagattctttttgatggggacataatcaaatttaagtctgagaaatatgcttaacagttggaactcaaattaaatgtactgattttaaagtttagacattaacaagtgatanattagcctcaaaaaaagacaatttggnaaggnttaggtcttttaatttggtgcttgntcacaacttgactggtgcttctttccttgctgcttcacatcaagcatggggccaattctattttcagtaaatg

SEQ ID NO: 753 - DNA, 467 bp, Homo sapiens
  misc_feature 1, 15, 77, 314, 317, 335, 419: n = A,T,C or G
nacaaccttagccanaaccatttacccaaataaagggataggcgatagaaattgaaacctggcgcaatagatatagnaccgcaagggaaagatgaaaaattataaccaagcataatatagcaaggactaacccctataccttctgcataatgaattaactagaaataactttgcaaggagagccaaagctaagacccccgaaaccagacgagctatctaagaacagctaaaagagcacacccgtctatgtagcaaaatagtgggaagatttataggtagaggcgacaaacctaccgagcctggtgatagctggntgnccaagatagaatcttagntcaactttaaatttgcccacagaaccctctaaatccccttgtaaatttaactgttagtccaaagaggaacagctcttggacacnaggaaaaaaccttgcagagagagtaaaaaatttaacacccatagtagg

SEQ ID NO: 754 - DNA, 196 bp, Homo sapiens
  misc_feature 17: n = A,T,C or G
gtcatgttcaagtgttntaatctgacgcaggcttatgcggaggagaatgttttcatgttacttatactaacattagttcttctatagggtgatagattggtccaattgggtgtgaggagttcagttatatgtttgggattttttaggcagtgggtgttgagcttgaacgctttcttaattggtggctgcttttagg

SEQ ID NO: 755 - DNA, 381 bp, Homo sapiens
ctggaaaggattctgtacatataagacatcaaatattgagggatactggaacttttaaattaatgggcaaagaaagtcaacaaaggaagttcatatgaaatcaaactagtaatatgattacaaaaaaaaagtttaaaatttttcttggccccagtcttatcatttctgagccaaatacaattctatcgaaatcacctgaaactgaaatcaccattctaggctggttttcccataaagatggactgctccaaaaagaggaatcaagaaagaatttggctcacagtgaattattcactttgtcttagttaactaaaaataaaatctgactgttaactacagaaatcatttcaaattctgtggtgataataaagtaatgaccgc

SEQ ID NO: 756 - DNA, 341 bp, Homo sapiens
  misc_feature 3: n = A,T,C or G
ggntataaacctattatttattgcagaactaataaaaaatccaaagccttgtatttgtacatctttattatctctaaagcactttcctcaacctaatttcagtttttacaattggtactcaagaaaatagagacagaaatcatttgattttgcccagaaaccatctgcttatatttataaggccacctaatttgaaatcacatatagaccaggcgcggtggctcacgcctgtaattccaacactttggaaggccaaggcaggtggatcacaaggtcaagagattgagaccatcttggccaacatggcgaaaccccgtctctaccaaaaatacaaaaatcag

SEQ ID NO: 757 - DNA, 479 bp, Homo sapiens
  misc_feature 4, 359, 425, 431: n = A,T,C or G
cgcnttactgtacatattgctagcagggagacaactggaaatactaaacaaatactggaattcacattacagacagacgaaaccaacatggatgccacacataacttcctttgtagtttcacagagagcctatttgtggttgctcaggtggggtcatacattgcttgcagaaatggcctgatcatagctctatgaaacaatgaattcggaatgaaatcttaccatgacacctctctgtaggaaagaaatgttgcttcacgtgtgctaagttgagataataatatttcacatatttatatacagagaatcactctcaaatttaacccaagataagcaataggatttgggggtgacttgtncacatttctaacaacacttttcttttttctagaggtcactctcaaacactgatatatcactatagnttgagngtagggattcaagtaatcaaaggttgttattgcaaaagagccaggcag

SEQ ID NO: 758 - DNA, 267 bp, Homo sapiens
  misc_feature 6: n = A,T,C or G
ccatgnctaggtttatagatagttgggtgggttggtgtaaatgagtgaggcaggagtccgaggaggttagttgtggcaataaaaatgattaaggatactagtataagagatcaggttcgtcctttagtgttgtgtatggctatcatttgttttgaggttagtttgactagtcattgttgggtggtaattagtcggttgttgatgagatatttggaggtggggatcaatagagggggaaatagaatgatcagtactgcggcgggtagg

SEQ ID NO: 759 - DNA, 449 bp, Homo sapiens
  misc_feature 371: n = A,T,C or G
cgaggtcttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcccgacatggagtctgatatacgttcatgggaattgtttctttctaatgttacaaaagaaattgagaaagcaaagtctcagtttgaagaacaaattaaggcaattaaaaatggttcccggctcagtgaactttctaaagngcagatttctgagctttcatttcctgcctgtaacacggttcatcccgagttactccctgagtcttcaggccacgatgg

SEQ ID NO: 760 - DNA, 414 bp, Homo sapiens
  misc_feature 5, 34, 136, 169, 173, 209, 227, 246, 269, 274, 291, 316,341, 414: n = A,T,C or G
ccatnaactggaagcagctcactaaacaaacagnggcatacccatagaactgcatacttctcagcagtatgaaagaatgagctacttatataagcatcattgataaacctcaaaaaaaaaatgccacatgaagaancccaagggggagaaacataaaaactttatatgncagncatataaaattctagaaaatgcaaactaatccatcntaaaggaaagtaaatcancagttgtctggaggaccanagagagcaggaggagagagattnttaanggggttaaagtaaattngggagtgcccttccatttttaaatnctatgaaaatgaaagtaaaggcccntgcatgttgtaaactaatagtaacaaacagattgggttggagtggggtgttgtctggggacatcattacaaan

SEQ ID NO: 761 - DNA, 428 bp, Homo sapiens
gagcctcactaaaataacagatttcagtatagccaagttcatcagaaagactcaaatggaatgatttacaagatagaacactttaaaccaggtcagtcctatctttttgtagctgaaggctatcagtcataacacaatttcgcgtacacctctgctcattatggaattacacttaaaacgaatctcaagagggtgaccattgttgtttcagataccatccctaaggagagtggttaacaggaagattgccagtgttactgatggaaagaagtgtttgtttgttttttttcttgtcaaagacttacaccatagttttaaattaaactgtcaggcattttctcagacaggttttccttttcaatgcagtaatgaagaactaagataaaaatcatgacttttgactgccactcaacattattacatgcacc

SEQ ID NO: 762 - DNA, 574 bp, Homo sapiens
  misc_feature 47, 190, 449, 509, 510, 552: n = A,T,C or G
caggtctgaactgataagtattaagagacgtttgttgctagttaagngttccagttgagagttcgaagtgaaaacctgggctctttaccagtgttgagtgagaagatttatttctctttcctctgaatttaccacatgtaacatcacagagacatgtagagttcctttaggatttgcgatttgaaccagnccagtctgattttcaggtgaattctgtgaagagcttgatgggggaagtctgaagacagaaggaattagggaaaagggtgatacttacagagtaaaggaaataaatgaaaagataatggtatttttggtagccacagggaaatagcaggaggggactggagatcacacacacgcacacgcacacacacaaacacacacacacgctaaaactcaaactaaaaacctcccaaaggagctgctttgtttgcagacttcaattngaagtagatactaagggcaagaatagaccagttaaaattcacctgaaaatctcttcccanncttcaaatgtgctaaaatatcactgtcagcttagcatctctncatgtatgtatatatagatgta

SEQ ID NO: 763 - DNA, 465 bp, Homo sapiens
  misc_feature 41, 116, 411: n = A,T,C or G
cctactatgggtgttaaaattttttactctctctacaaggntttttcctagtgtccaaagagctgttcctctttggactaacagttaaatttacaaggggatttagagggttctgngggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggatataatttttcatctttcccttgcggtactatatctattgcgccangtttcaatttctatcgcctatactttatttgggtaaatggtttggctaaggttg

SEQ ID NO: 764 - DNA, 151 bp, Homo sapiens
ctgtcaattaatgctagtcctcaggatttaaaaaataatcttaactcaaagtccaatgcaaaaacattaagttggtaattactcttgatcttgaattacttccgttacgaaagtccttcacatttttcaaactaagctactatatttaagg

SEQ ID NO: 765 - DNA, 251 bp, Homo sapiens
gaagagcttatcacctttcatgatcacgccctcatagtcattttccttatctgcttcctagtcctgtatgcccttttcctaacactcacaacaaaactaactaatactaacatctcagacgctcaggaaatagtaaccgtctgaactatcctgcccgccatcatcctagtcctcatcgccctcccatccctacgcatcctttacataacagacgaggtcaacgatccctcccttaccatcaaatcaattgg

SEQ ID NO: 766 - DNA, 375 bp, Homo sapiens
  misc_feature 10: n = A,T,C or G
cgaggtctgncctcctggttcttcatccattattaacagaagagcatactggtttcggtccataaaatctttgggaagggacaactgtaaaggaagttcatagtcgtcaatatgaaggattttaatttctggctttcctatcttcttcttcaggatagcttccttcagcatagaattgttttccaatataaaatattttgctgggttgtccgtactatgtaggctgaccactgggacccttggaccttcacagaataataagaaatgttgattcatgggactaaaactggcatcaaaatatgtacattgttctttcatgaaattacatgaaatgcattggcgattcaataatccttcagtagaagcactgtacag

SEQ ID NO: 767 - DNA, 485 bp, Homo sapiens
  misc_feature 70, 160, 386, 408, 440, 484: n = A,T,C or G
cgaggtctgaaccctcgtggagccattcatacaggtccctaattaaggaacaagtgattatgctaccttngcacggttagggtaccgcggcccgttaaacatgtgtcactgggcaggcggtgcctctaatactggtgatgctagaggtgatgtttttggnaaacaggcggggtaagatttgccgagttccttttactttttttaacctttccttatgagcatgcctgtgttgggttgacagtgagggtaataatgacttgttggtgattgtagatattgggctgttaattgtcagttcagtgttttaatctgacgcaggcttatgcggaggagaatgttttcatgttacttatactaacattagttcttctatagggtgatagatnggtccaattgggtgtgaggagntcacttatatgtttgggattttttaggtaagngggtgttgagcttgaacgctttcttaattgggggctgcttttang

SEQ ID NO: 768 - DNA, 379 bp, Homo sapiens
  misc_feature 35: n = A,T,C or G
ctgatattctattaaagatacaaagaggagctggnaccatttcttctgaaactattacaaacaactgaaaaggtggaatttctccctaattcattttaggaggccagcattatactgataccaaaacctggcagaggtacaataataaaaggaaacttcaagtcagtatcactgatgaacaccaatgtgaaaatcctcaataaaatactggcaaactgaattcagcagcacatcaaaaagctaatccaccacaatcaagtcagcttcatccctgcgatgcaagtctggttcaacatatgcaaatcaataaatacaattcatcagataaacagagctaaagacaaaattcacatgattttctcaatagatgcagaaaagg

SEQ ID NO: 769 - DNA, 518 bp, Homo sapiens
  misc_feature 282, 460, 490: n = A,T,C or G
cgaggtccatatgatgatcagtctatatagtttaaggcgcagatacacaaattttcaaaaatatgggtagaatatagtcaatatgaatggaatagacaatgctttgaaaatcactggagggaggctttattgtttgtgaaaacatgttgtcatcactttttgctttaagcccttggtggtgaaataactcaaaccattcttccttatgctgaagatcgagaaccccaagtatcacatctaccatcccactcatcaatgtgattggtcagtctttgctgaggncctgcatagccagttttaaagttagagttcttgcatatacatatgaaaaggcatgttacttgtgctttcaaagagctttttgcttggtgtaaaaagaaaactcaaattacagtgtgatgtggaatataatggtggtagtttcatcgagatgatgggaaagaattgataagataaagcngaaagatgagcagaattttcagattgggtntggaaagagcacttaagaaagagggtgg

SEQ ID NO: 770 - DNA, 378 bp, Homo sapiens
  misc_feature 163, 283, 340: n = A,T,C or G
tatgggtcctgagtgtggaatataagataacaagacaattcccttgctttcaagggaaatcacactttataaaactttgaattcttgaaatgggtttcagaggttccaaggtcaaattcaagaataagagttaagaagaaaaagactatgagaaaggaagtgntgaccccatttgcatttaaatggcaggaatagtctcaatctactcattggggaaaaatgtatgttgcatatttttgagatattgcaacttgctctctctctttgccaccccaccctttgncatgctctgtttttgggctgaattggcaagaaaaatggctggagggctggaagaagntggacccttcttccttcttccttcttccttctttctcc

SEQ ID NO: 771 - DNA, 207 bp, Homo sapiens
cataaatattatactagcatttaccatctcacttctaggaatactagtatatcgctcacacctcatatcctccctactatgcctagaaggaataatactatcactgttcattatagctactctcataaccctcaacacccactccctcttagccaatattgtgcctattgccatactagtctttgccgcctgcgaagcagcggtagg

SEQ ID NO: 772 - DNA, 384 bp, Homo sapiens
  misc_feature 115: n = A,T,C or G
cctactatgggtgttaaattttttactctctctacaaggttttttcctagtgtccaaagagctgttcctctttggactaacagttaaatttacaaggggatttagagggttctgngggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttccc

SEQ ID NO: 773 - DNA, 182 bp, Homo sapiens
cccttttcctaacactcacaacaaaactaactaatactaacatctcagacgctcagggaaatagaaaccgtctgaactatcctgcccgccatcatcctagtcctcatcgccctcccatccctacgcatcctttacataacagacgaggtcaacgatccctcccttaccatcaaatcaattgg

SEQ ID NO: 774 - DNA, 191 bp, Homo sapiens
ccatggctaggtttatagatagttgggtggttgggtgtaaatgagtgaggcaggagtccgaggaggttagttgtggcaataaaaatgattaaggatactagtataagagatcaggttcgtcctttagtgttgtgtatggctatcatttgttttgaggttagtttgattagtcattgttgggtggtaattag

SEQ ID NO: 775 - DNA, 192 bp, Homo sapiens
  misc_feature 12, 45, 51, 62, 90, 114, 134, 163: n = A,T,C or G
ccatggctaagntatatagatagctgggtggctggagtaaatgantgaggnacgagtccgangaggttagttgaggcaataaaaatgatnaaggatactagtataagagatcangttcgtcctttacatgttgngtatggctatcatttgttttgaggctagnttgattagtcattgttgggtggtaattaa

SEQ ID NO: 776 - DNA, 144 bp, Homo sapiens
ctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaa

SEQ ID NO: 777 - DNA, 483 bp, Homo sapiens
  misc_feature 14, 339, 461: n = A,T,C or G
cctactatgggtgntaaattttttactctctctacaaggttttttcctagtgtccaaagagctgttcctctttggactaacagttaagtttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggntaagtccttgctatattatgcttggatataatttttcatctttcccttgcggtactatatctattgcgccaggtttcaatttctgccgcctatactttatttgggtaaatggtttggctaangttgctggtagaaggtggagtg

SEQ ID NO: 778 - DNA, 393 bp, Homo sapiens
  misc_feature 295, 297, 370: n = A,T,C or G
ctgcatttttattgcgatctgcagatgaactgggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagngngtcaccataaatatcaggggcataaaaggctatctattcttaattcaaggataaaacagaagaagcttgtggnataaaacaatagtcaagatccag

SEQ ID NO: 779 - DNA, 277 bp, Homo sapiens
  misc_feature 4: n = A,T,C or G
cctnttgatttgatgggtaaggggagggatcgttgacctcgtctgttatgtaaaggatgcgtagggatgggagggcgatgaggactaggatgatggcgggcaggatagttcagacggtttctatttcctgagcgtctgagatgttagtattagttagttttgttgtgagtgttaggaaaagggcatacaggactaggaagcagataaggaaaatgactatgagggcgtgatcatgaaaggtgataagctcttctatgataggggaagtagcgtcttg

SEQ ID NO: 780 - DNA, 328 bp, Homo sapiens
  misc_feature 5, 19, 33, 38, 84, 323: n = A,T,C or G
catgntatggataaccatnttaactgtattttntgcancccgtaccttcttgggaatacaattgtctaactttttatttttggnctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaggggagcgaccttatctctgtgcttcgggaagctaancaaac

SEQ ID NO: 781 - DNA, 305 bp, Homo sapiens
  misc_feature 75, 237: n = A,T,C or G
ctgttcagaaagctcattggacctggttttgaaaataaaacaaagttaaaaccctgggaggagttattgtgcagngtggagtactcaggctttcttataaagaaaaaaaaagttatctggtaccaaagtgtgcaacctacagaccctcaggtactgccctgtgacttctctgtatgacatcacaaggctgccaagtgcctgtttttctagaactaggagttggtgaggtttggctantgctgaaaccatgcataggattggtttactaaattaaaaccttattacgtacgtcctccaaaagacag

SEQ ID NO: 782 - DNA, 497 bp, Homo sapiens
  misc_feature 385, 433, 440, 471: n = A,T,C or G
cgaggtggctttaattgatgttaatgccttatgtcaaatgtaaagttagaatttgctagggctgggatagggagtgatatttctaggacttagacattgaaaactaattcagcctgtagtaacctggatggttttcaatggcatggttagtcaaattcatggttttaaacttagaagcagctttcgggggagagggtaggttggagcatttattacatattttactgtttaatgtcttaaccgtgggccttttaatttgtaaacactgaaatgattgttgggctgtggaaaacatttacctatttaccttggaagttttaaaagacagtccactttttagcatgtgtgttgcgtccagcctgtggtcgtcttaactaataaatgngatttttctctcaaaaaaaaaacctccccgggcggccgctcaagggcnaattccncacactggcggccgttactaggggatccganctcggtccaagcttggcgtaatcatg

SEQ ID NO: 783 - protein, 364 aa, Homo sapiens
MWQPLFFKWLLSCCPGSSQIAAAASTQPEDDINTQRKKSQEKMREVTDSPGRPRELTIPQTSSHGANRFVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 784 - DNA, 6353 bp, Homo sapiens
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatatacatatgcagcatcaccaccatcaccactggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaatgactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 785 - DNA, 5502 bp, Homo sapiens
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatatacatatgcagcatcaccaccatcaccactggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgtttgatgaattctgcagatatccatcacactggcggccgctcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 786 - protein, 108 aa, Homo sapiens
RRSCEPATRVPEVWILSPLLRHGGHTQTQNHTASPRSPVMESPKKKNQQLKVGILHLGSRQKKIRIQLRSQVLGREMRDMEGDLQELHQSNTGDKSGFGFRRQGEDNT

SEQ ID NO: 787 - protein, 152 aa, Homo sapiens
RPKEEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNPQAAGD

SEQ ID NO: 788 - DNA, 1633 bp, Homo sapiens; identical to SEQ ID NO: 316

SEQ ID NO: 789 - protein, 200 aa, Homo sapiens
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 790 - DNA, 457 bp, Homo sapiens
ttcgcctgtgttgggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgc

SEQ ID NO: 791 - protein, 126 aa, Homo sapiens
SPVLGTRRSCEPATRVPEVWILSPLLRHGGHTQTQNHTASPRSPVMESPKKKNQQLKVGILHLGSRQKKIRIQLRSQCATWKVICKSCISQTPGINLDLGSGVKVKIIPKEEHCKMPEAGEEQPQV

SEQ ID NO: 792 - DNA, 461 bp, Homo sapiens
cggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaatgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttc

SEQ ID NO: 793 - protein, 108 aa, Homo sapiens; identical to SEQ ID NO: 786

SEQ ID NO: 794 - DNA, 970 bp, Homo sapiens
tgggctcccagagctcgggtcctttgcagcctccaccctggcgatggctccctggtcctactttctctctcaaactggctttttctcattcctttgactccgccagacttcctcgcccccatgacctggtgttgtgtctgatcaccccaacattcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaagaatcatctcttttgaaaaatcgattcatcaaatgaatcttcagccaacaactgttcaagaaggatgcaaatatcacagtgttagatgaactttctggttgacacctgacaggaagagcctctgtattggaccaccatgtttgtgctcactgtgtagtaacaaaccaacacaccaaaatagcgggagttgccactgacaaagagttgaatgatcaaatgacggccaaaggaggaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaacccgcaggcagctggagat

SEQ ID NO: 795 - protein, 152 aa, Homo sapiens; identical to SEQ ID NO: 787

SEQ ID NO: 796 - DNA, 2435 bp, Homo sapiens
atccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtcycttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaaaaaaaaaaaaaaaaaaaa

SEQ ID NO: 797 - protein, 120 aa, Homo sapiens [sequence omitted]

SEQ ID NO: 798 - protein, 164 aa, Homo sapiens
PRVRGRVGSASHGGTWRAEPESGWGPRGRGRTAAGSGEKRALPWHGPPPPAARNGMARPELRPGGGGESRGGGDDGAACRRNAGQGRRGSGGARGARAERRRAGRQHPLGPHRRGAQRAAERAHPAAAVRVGPRQGAEPRGHDPGGPRQRAPHRCPLDQRGPGR

SEQ ID NO: 799 - protein, 60 aa, Homo sapiens
HASADAWAARVMAAPGERSRSRAGDRGVEAGPRRGRGRNARCPGTGPPPRPRGMVWPGRS

SEQ ID NO: 800 - DNA, 2477 bp, Homo sapiens
gccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctactttggtctccataacttctatgttttctttccttctgacacactagtgcccctaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggttagggagatgggagggcaccaggaaaagtgattagaagtcaggtatgggaaggctaaataggacagagtcgagtacatctctgcttggaaaaacatatcaacacccttttttttgaacattatatcttgctcataaaagaaaactttccacattgttttaacaaaccccacagctgagagtcaggcctgaatctttgatgtgtgcccagtcacagagttgaccctattggtttgtggtggggcagggcatcaaagacatcattgactaatcacattcccctgaatagctcatatttagaaaatattcttagattctaaaaatgtactattaatttgtgatattcagtcttttaaatattttatacattaaacaggcatagttacaaatataaaacaaaaatatcccaaagccattatgcatggcactcaagattaaaatgggaaataatacatctaataaatcaaatgttccaagacttcaaaggtcttttggaaacaggctatgtaaaacagcacactggtttcaaactttggtaaattttaagaacaactcttacaaaggcatttaattcttatacataattttcaggggacctaagttaatcagctaatcatgaagacatgattttcattttagaaaacacttttgaaaacttgggataatctcatgccttaatgatcaaagcattatgagaaggacagtggtttttaacctgggcatatgttctaacacatttactctccactattcgtactctggtagccatgttaaccccatcagagattccttctcaagccatgtctcagagctgagaggcatcccagcaagttttgcagctcacagttttttccgtaaattacttattctataaaattggagtaggccataaactttggagggccctagaccaattttttggattatttttcgtcttctatcattccgctgatcttagatattctctgcattaaatattaaatatcacttctaggctgaaaaatccccctaaaaatatttctagctcagatttttcctccaaattctgcaatagaagatcacaatgtgaactctgcatctccatgttaaagtctaatggacattcacacttagcatgtctcaaagaaatctcatgtaaaccatggccatcctgttctaccttaactttctgagtctatggaatgataatttcacatctcataaacttgactgatgtaagtgtcaagaaaagattgacattttgttaaaagttagtagtgaagtgtgtaacgcttaagcaaactttcatatttcaaatctctttagcaagtgtaactcttttttcaagatgtgaaataatcattaggtcagtcatttgtaaatagtacatctgctatggactttttccagttcttcaccatccatttttataaaactcttattgttaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaaaaaaaa

SEQ ID NO: 801 - DNA, 1619 bp, Homo sapiens
ggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcattatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagaattaggtttgaattgctttttaaaaaaaa

SEQ ID NO: 802 - DNA, 3115 bp, Homo sapiens
cgtccgcggacgcgtgggctcatcttgagaagcaggcgggttgggtgggaggaggaagaaagggaagaattaggtttgaattgcttttttaaaaaaaaagaaaagaaaaaaaaagacagcatctcactatgttgccaaggctcatctcaagctcttgggctcaagagatcctcccacctcggcctcctgagtagctgggactgcaggtgtgtgtcatcatgaccaatgtgaattgcttttgaagctggttcatgggcatgtaggccaccgaagcaattttagaccacagtaagtcaagcttttttccctccgatgatcactgggtggttgcagcattttttgcataaacctgcctaagacttgtctatcgtctgtgatcaatatgccatattacactaaggtgctcctggaaaattgggtgcagttcaaattttcctacagcaaatcatttggcaaggccagccattggggaaaccagacaactagagataaccctgaaatgaatccttttgtaaattgaagcaccatcttttctttttttgcataaattggaggttttaattttagggcagttacctgaagtgaaatataccaacaatttcttgtgttctttaaattcctagttaggtgaatatttttgaaggtcctcttttgaataaagaggggaatggacaccacatttcaggtcttctcgaagtgtggaagggcaagagagcatcagtgagctgatggtggattgcttacatcggattccattggtatgaatttcccaaactggaaatcaaagcgccagggtggggttggggctgactgctggtgagggggctggccgctggctcccgtgacgtgcgtcatgggcacgcaggcgccattttgaatctatcgtcggcacgtgggtgccattttgaatccttagttgggcctttctaaatggagaatggctttggagggagacacgttttctgtggggagggtttgggggggagggaggagggaacaagctacatgctattttgtttgtagtattgtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgaggggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgtgttgaggagccctgggggaaatggaccaagttttcccacagagcagtattaggctgaagagcaggtgactggtaggccccagctcccatcattccctcccaaagccattttgttcagttgctcatccacgctggattccagagagttttccaatttgggaagccatgagaaaggtttttaaatcttgggaagatggagagagggacataggatagttgactccaacatgacaggaagaggctggagattgggaattggccatcaaccaagcctgtagtagtaaagccatggtcccgcattggaattacttggggaacttatacagttctgatacccaggctctcctagaccagttcaaccaattctaggtgggggactcaggcatcagtgtgtttcgtagctccccgggtgttttccctgtgcagccgagcttgggaaactgccatgctttttggatgtcaaggcgctgttggaggctgggtgtgacagcacagagccaggttgtcttgtggaaaccacagccacgggtttgccactggctcagcatggcctcactgccagtcccagcctggctgagggacaagatggtttctcttgggagttcctgagtggagcacccttccaggctttttgaaagccagctgatctgtggagccttgttaagggactcaatacggtgtttggatattgatgtttttccttgagactgtcttgtccatcaataaagatggaggatgtctcctctttgaaccccgcttccccaccagtactctctctcccttagagtttatgagttattcaaggaggagacttcttaaagacagcaacgcaattcttgtaacttgtgtaaatagccccatctttcagagtgataccatttctacatttgataatgcctgtattcctgtaggatgtatatagtttaggggattttttttttgtttggttttgttttttagaagtcaatatgtctggttttatttattgcttgaaaaagatcatttgaaaaaaataaa

SEQ ID NO: 803 - DNA, 1238 bp, Homo sapiens
cccgggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagcgccacagagcccttggacctggactgcagctcctgtgggaccccactacacgaccaggagggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgggggagcggggcaagacccccgccacccccacctcgcagttcgtcttcagctttccggtctccgtgggcgtgcactcggcccccagcagcctgccctacctgcacagccccatcaccacctctcccagctgttag

SEQ ID NO: 804 - DNA, 4637 bp, Homo sapiens
ggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcattatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagaattaggtttgaattgcttttttaaaaaaaaagaaaagaaaaaaaaagacagcatctcactatgttgccaaggctcatctcaagctcttgggctcaagagatcctcccacctcggcctcctgagtagctgggactgcaggtgtgtgtcatcatgaccaatgtgaattgcttttgaagctggttcatgggcatgtaggccaccgaagcaattttagaccacagtaagtcaagcttttttccctccgatgatcactgggtggttgcagcattttttgcataaacctgcctaagacttgtctatcgtctgtgatcaatatgccatattacactaaggtgctcctggaaaattgggtgcagttcaaattttcctacagcaaatcatttggcaaggccagccattggggaaaccagacaactagagataaccctgaaatgaatccttttgtaaattgaagcaccatcttttctttttttgcataaattggaggttttaattttagggcagttacctgaagtgaaatataccaacaatttcttgtgttctttaaattcctagttaggtgaatatttttgaaggtcctcttttgaataaagaggggaatggacaccacatttcaggtcttctcgaagtgtggaagggcaagagagcatcagtgagctgatggtggattgcttacatcggattccattggtatgaatttcccaaactggaaatcaaagcgccagggtggggttggggctgactgctggtgagggggctggccgctggctcccgtgacgtgcgtcatgggcacgcaggcgccattttgaatctatcgtcggcacgtgggtgccattttgaatccttagttgggcctttctaaatggagaatggctttggagggagacacgttttctgtggggagggtttgggggggagggaggagggaacaagctacatgctattttgtttgtagtattgtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgaggggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgtgttgaggagccctgggggaaatggaccaagttttcccacagagcagtattaggctgaagagcaggtgactggtaggccccagctcccatcattccctcccaaagccattttgttcagttgctcatccacgctggattccagagagttttccaatttgggaagccatgagaaaggtttttaaatcttgggaagatggagagagggacataggatagttgactccaacatgacaggaagaggctggagattgggaattggccatcaaccaagcctgtagtagtaaagccatggtcccgcattggaattacttggggaacttatacagttctgatacccaggctctcctagaccagttcaaccaattctaggtgggggactcaggcatcagtgtgtttcgtagctccccgggtgttttccctgtgcagccgagcttgggaaactgccatgctttttggatgtcaaggcgctgttggaggctgggtgtgacagcacagagccaggttgtcttgtggaaaccacagccacgggtttgccactggctcagcatggcctcactgccagtcccagcctggctgagggacaagatggtttctcttgggagttcctgagtggagcacccttccaggctttttgaaagccagctgatctgtggagccttgttaagggactcaatacggtgtttggatattgatgtttttccttgagactgtcttgtccatcaataaagatggaggatgtctcctctttgaaccccgcttccccaccagtactctctctcccttagagtttatgagttattcaaggaggagacttcttaaagacagcaacgcaattcttgtaacttgtgtaaatagccccatctttcagagtgataccatttctacatttgataatgcctgtattcctgtaggatgtatatagtttaggggattttttttttgtttggttttgttttttagaagtcaatatgtctggttttatttattgcttgaaaaagatcatttgaaaaaaataaa

SEQ ID NO: 805 - protein, 394 aa, Homo sapiens
MVTMEELREMDCSVLKRLMNRDENGGGAGGSGSHGTLGLPSGGKCLLLDCRPFLAHSAGYILGSVNVRCNTIVRRRAKGSVSLEQILPAEEEVRARLRSGLYSAVIVYDERSPRAESLREDSTVSLVVQALRRNAERTDICLLKGGYERFSSEYPEFCSKTKALAAIPPPVPPSATEPLDLDCSSCGTPLHDQEGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLGERGKTPATPTSQFVFSFPVSVGVHSAPSSLPYLHSPITTSPSC

SEQ ID NO: 806 - protein, 302 aa, Homo sapiens
VRARLRSGLYSAVIVYDERSPRAESLREDSTVSLVVQALRRNAERTDICLLKGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 807 - DNA, 3829 bp, Homo sapiens
gtttgaaagtgtgtagcacctccaccttctctctctctctccctctccctctcctgccagccaagtgaagacatgcttacttccccttcaccttccttcatgatgtgggaagagtgctgcaacccagccctagccaacgccgcatgagagggagtgtgccgagggcttctgagaaggtttctctcacatctagaaagaagcgcttaagatgtggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacctactttggtctccataacttctatgttttctctccttctgacacactagtgcccccaaattgtgatttgcctatacgtttagggccgggattggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgaccagcaattcatgggctccctccagcagtgcgagggtcagagtttctggagccttgggaggaggcaaccctgtgagggggggttagggagatgggagggcaccaggaaaagtgattagaagtcaggtatgggaaggctaaataggacagagtcgagtacatctctgcttggaaaaacatatcaacaccctttttttttgatcattatatcttgttcataaaagaaaactttccacattgttttaacaaaccccacagctgagagtcaggcctgaatctttgatgtgtgcccattcacaacgttgaccctattggtttgtggtggggcaggacatcgaagatatcattgactaatcacattcccctgaatagctcatatttagaaaatattcttagattgtaaaaatgtactgttcatttgttatattcaatcttttaaatgttttatactttaaacaaggcatagttacaagtataaaacataaatatcccaaagccattatgcatggcactcaagattaaaatgggaaataatacatctaataaatcaaatgttccaagacttcaaatgtcttttggaaacaggctatgtaaaacagcacactggtttcaaactttggtaaattttaagaagaactcttacaaaggcatttaattcttatacataattttcaggggacctaagttaatcagctaatcatgaagacatgattttcgttttagaaaacacttttgaaaacttgggataatctcatgtcttaatgatcaaagcattatgagaaggacagtggttttttacctgggcacactttctaacacatttactctccactattcgtactctggtagccacgttaaccccatcagagattccttctcaagccatgtctcagagctgataggcatcccagcaagttttgcagctcacaatttttctgtaaattacttattctataaaattggaagaggccataaactttggagggccctagaccaattttttggattatttctggtctactctcattccgttgatgatcttagatattctctgcattaaatatcacctctaggctgagaaatccaccaaaaaatatttctagctcagcgttttcctccaaatcttcaatggaagatcataatgtgaactctgcatctccatgttaaagtttaatggacattcacatttagcatgtctcaaagaaatctcatgtaaaccatggccatcctgttctaccttaactttctgagtctatggaatgataatttcacatctcataaacttgactgatgtaagtgtcaagaaaagattgacattttgttaaaacttcgtagccaagtgtgtaacgcttaagcagactttcatatttcaaatctctatagcacgtgtaactcttttttcaagatgtgaaataatcattaggtcagtcatttgtaaatagtacagctgctgtgggctttttccagttcttcaccatccatttttataaaactcttattgttaaaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaaaaatggattctactcattattttacttccatttaagatataaatgtagagaaataagtataattctaagctaatacgtacgcaatgtaggaagctgtaattactgaccaaaactatgtgaagtggagaaaacctggggaagtggatggttttagatgaaactgaagttaaattcatattgatttaaagtaaattgttataactttataaagtttttcatcatcaccacagcaatcacaaagagaataattatgaatatacgcaagaggaaatgagaagggaatccaaatgtcattaaaaaaaaa

SEQ ID NO: 808 - DNA, 781 bp, Homo sapiens
gcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcgacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaaaaaaaaa

SEQ ID NO: 809 - protein, 160 aa, Homo sapiens
MRCHAHGPSCLVTAITREEGGPRSGGAQAKLGCCWGYPSPRSTWNPDRRFWTPQTGPGEGRHERHTQTQNHTASPRSPVMESPKKKNQQLKVGILHLGSRQKKIRIQLRSQCATWKVICKSCISQTPGINLDLGSGVKVKIIPKEEHCKMPEAGEEQPQV

SEQ ID NO: 810 - DNA, 624 bp, Homo sapiens
  misc_feature 5, 74: n = A,T,C or G
atganaaggagatgacacaaaagttagatctcatcacaagtgatttggcagattaccagcagcccctcatgatnggcaccgggacagtcacgaggaagggctccaccttccggcccatggacacggatgccgaggaggcaggggtgagcaccgatgccggcggccactatgactgcccgcagcgggccggccgccacgagtacgcgctgcccctggcgcccccggagcccgagtacgccacgcccatcgtggagcggcacgtgctgcgcgcccacacgttctctgcgcagagcggctaccgcgtcccagggccccagcccggccacaaacactccctctcctcgggcggcttctcccccgtagcgggtgtgggcgcccaggacggagactatcaaaggccacacagcgcacagcctgcggacaggggctacgaccggcccaaagctgtcagcgccctcgccaccgaaagcggacaccctgactctcagaagcccccaacgcatcccgggacaagtgacagctattctgcccccagagactgcctcacacccctcaaccagacggccatgactgcccttttgtgaacacaatgtgaaagaagcctgctgtggtactgagcgtcgg

SEQ ID NO: 811 - DNA, 572 bp, Homo sapiens
agcgggctgtgaggacgctctgggccaggctgcagcgcgagcgttccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagatccgcgagcaggacctggaacgcgcgggcctgcggcagcgggagttagagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacgagacgtggtcgccgtctccaggaacatgcagaaagagaaagtcagcctgctacggcaactggagctgctcagggagctg

SEQ ID NO: 812 - DNA, 594 bp, Homo sapiens
  misc_feature 45: n = A,T,C or G
cggaagttggcgcagcgcggttgccaatggtcgctccctgatttnatgccgctcgtggtgttttgcgggctgccgtacagcggcaagagccggcgtgctgaagagttgcgcgtggcgctggctgccgagggccgcgcggtgtacgtggtggacgacgcagctgtcctgggcgcagaggacccagcggtgtacggcgattctgcccgtgagaaggcattgcgtggagctctgcgagcctccgtggaacggcgcctgagtcgccacgacgtggtcatcctggactcgcttaactacatcaaaggtttccgttacgagctctactgcctggcacgggcggcgcgcaccccgctctgcctggtctactgcgtacggcccggcggcccgatcgcgggacctcaggtggcgggcgcgaacgagaaccctggccggaacgtcagtgtgagttggcggccacgcgctgaggaggacgggagagcccaggcggcgggcagcagcgtcctcagggaactgcatactgcggactctgtagtaaatggaagtgcccaggccgacgtacccaaggaactggagcgagaagaatccggggctgcggag

SEQ ID NO: 813 - DNA, 561 bp, Homo sapiens
  misc_feature 121, 352, 368, 440, 445, 486, 497, 516, 528, 540, 550, 552: n = A,T,C or G
tctgacacacgagaccggttatcccatctccgcgcccctctgtgggtattacacagccactagatgaagccaaacattgttggaggtactgaaatcttagactccaccatgtgtccaggancccattgacgtcctctcttctgaaaactccgtgtggccctcgctctgcactgtcatgaggcggtgatggagctagatacccaccacggacaatgatcatcagtttggggttctctgggtctcacagggacgcacattctaggggtagcacgacactccccctgtagttgctccacacaaacgggatctctcatccaggcgatacgtctggtcctgtggcatgtggctctcnacgaaacaccagggangcattatgttggggacttcttggggctctgctggtctctgctccagacacgattaatccgaaatgtgttaantcgancacatgggtccacgtccaggacagctcccatcgaactctcnaggctctctanctcagggatgaaggaggtnaagtgatcgatnctcacaagcganagctctcgcncnatatctgcg

SEQ ID NO: 814 - DNA, 307 bp, Homo sapiens
  misc_feature 2, 6, 9, 24, 26, 45, 46, 63, 64, 73, 81, 82, 91, 95, 138,148, 151, 188, 205, 206, 212, 223, 229, 234, 242, 245, 248,252, 258, 262, 270, 278, 280, 301: n = A,T,C or G
cntcgnggngttggttgtgtgggntnttctcgggtgattgggtgnnattactggacccaaccnncgtggaaanggctgggnncgcggccgntctngcagaagtatcccgatttttttttttttttttttttttttggnggagggaaanttncagacatagctttattgctgactcctgcccccttcanagccctagtcacaggcnncagggntgttttgtaanttaaantttcnggaaaatnggngtntttntgcatncaanagaagggntgccaaangnggggtattgcttctgggtggnttaccc

SEQ ID NO: 815 - DNA, 784 bp, Homo sapiens
  misc_feature 596, 656, 727, 763, 768: n = A,T,C or G
ggcacgagatataatcagactcttactcctgtacttctagaaatgatgcaaacacttcaaggacccacaaatgtggaagatatgaatgcactgttaatcaaagatgctgtgtataatgctgttggattaagctgcttatgagctctttgacagtgttgattttgatcagtggtttaaaaaccagcttcttccagaattacaagtcattcacaataggtataagccattgcgacgcagggtgatttggctcatcggtcagtggatttctgtgaaattcaagtctgacttaagacccatgctttatgaagcaatctgtaacttgcttcaagatcaagatttagtggccgtattgaaacagctacaactttgaagttaactgttgatgattttgaatttagaacagatcagtttctaccgtatttggaaaccatgttcacactactttttcagttactgcagcaagttacagaatgtgacacaaagatgcatgttttgcatgtcctttcttgtgtgatcgaaagagtcaacatgcagatacgaccatatgtgggatgtttggtacaatatttgcccctcctttggaagcagaagtgaanaacacaatatgttgagatgtgctattttgaccacacttattcatcttggtcagggattangagcagacagcaagacctgtccctttcctgctccagttattcactgagtaccagatgtttcacagccttcncatgtttatttttctggaaaatgggttaaaaatatnggtangaacctttgggaaaac

SEQ ID NO: 816 - DNA, 813 bp, Homo sapiens
  misc_feature 740, 788, 790, 798, 811: n = A,T,C or G
ggcacgagcaggctgggaagaagtccttgcttctcaaggccacgtaccggccgcgtccttccacccttgccctttaaaccacagatgccaaatgatacgccaacagacactacattccccagcagctgctgccagagccctcttgtagcttctttattttctgtttctttccagctttcctaccctcctatccccccttgtgtttgggccacaattttgaaataatttttattataggtatgtgctgccaaagccagatttttataaggtaaaataaattaagaatttaaacagtaaaagccagtgtctcaaaatgtcagcattaaaatgtgaaggggacagcagggtgtgaaccggaaacacacattgccaaacagttgccaactgaactgctgcttctcatggtccgttcttttctttgcccttaaggtcaatgccagtgtccagacgagcagtgtagaaaagctccctgtgtggtttgtcgtgaggtctgcttgtatctcttcactggcgttagtttcattagctctttattctccttacgttcgagtgaatctgccaagaacactggtggatagtattatcctaacacttttggtttgggggcggggagggggcagggaatagtgagctggctttaccaccttcaggatctcgaattgggcgcttgaacctaagaaagattgtggacttatcaaaagtcaccgctcagtgttcgtcaagcatgtatttatgtgacnatcatactagggaggggatggttgggaattcttccatgtgcaaatttngncccgcaanaagcaaaactggngt

SEQ ID NO: 817 - DNA, 229 bp, Homo sapiens
  misc_feature 30, 57, 102, 112, 124, 222: n = A,T,C or G
gaaacttttacattaatgatttattaaaanaaacaactccttgtcccactccactgngctgcttgtaatctccatacatggcctccattttcaactgttttnttggtcacanagctccaaacanacacatttttttttccaggtaaaagctgtttttagtttgtagtacaaatgtgactgcatccaatactgacacattgttcctttggcccacagtcccantcaccac

SEQ ID NO: 818 - DNA, 781 bp, Homo sapiens
  misc_feature 355, 437, 539, 557, 569, 593, 608, 635, 636, 653, 654, 662,665, 674, 697, 699, 708, 724, 734, 743, 755, 763, 764, 769,775: n = A,T,C or G
ggcacgaggtgtgtgtgtgtgtgtgtgtgtaacacatgggcattggtccttccaggacaacttggttagggctccagggtggcctctcaggcaggaacaggcttttttcctcctgtcttttcctcacatcacgtcctgccccaggtcactgcataaataagtgctttggaaagtattcatctagaaagtaacataaatactgtacatagaaaagggttgccgccccttagccttcgcactgccccagagagctctccacatattgcacacggcctccccagccctgtggggtccaggcctggctgtgtctttggtagaagcttcagggacagttcctgggcagcccccacatctncaccctgctcccaaaggggagctctagggtagtcagtgggtaccagaagccttgctcggcctcgctggtggccttctaccanggatgctttcacaaggatgagacagaatcccaatggtatgcccctgcttggacactctgctcaaggtctgcatgtggcctgggaggagacaggcaggctganggcaggtggacaggtgantcctggccacanaaggcaggctcacacccttcacangaataggtggtttgngctgtcatctcggcccacggtctcctnntgcgccacccccccttnntgaatcgnaantcctcaaancccttaccaccacttgatgaccnancatttttanggcctggcttgaaggngggggccttnggccccccnaagggggaaatncccccggnngaatncccaanggggaa

SEQ ID NO: 819 - DNA, 199 bp, Homo sapiens
  misc_feature 2, 3, 4, 12, 20, 21, 22, 36, 37, 49, 76, 80, 83, 88, 157,165, 167, 177: n = A,T,C or G
cnnngtggaaanggctgggnnngcggccgttttcgnngtagtatcgcgnttttttttttttttttgtgggaggttntgcngtntttgnttgctctctcaaattccaggaattgacttatttaattaatgcctgcaacctgtgctagcaaatatttgnacaaaacnanttgtgttggngatgttcttttgggtcgggcag

SEQ ID NO: 820 - DNA, 211 bp, Homo sapiens
  misc_feature 1, 2, 3, 128, 131, 150, 157, 159, 166, 172, 174, 180, 182,185, 192, 202, 206: n = A,T,C or G
nnnggcacgaggagagagagagagagagagagagagagagagagagagagagagagagagagagagagagagagagagagagagagagagagagagagagagagagagagagagagagagagacagtnctntgtgtgtctctctgtctcnaagtacncnctgaggnatctgntntctgtntntgngtacacngtatctctcntggncatat

SEQ ID NO: 821 - DNA, 952 bp, Homo sapiens
  misc_feature 1, 2, 3, 29, 688, 692, 702, 742, 749, 767, 774, 786, 805,815, 828, 835, 840, 842, 854, 864, 868, 871, 879, 889, 890,895, 900, 904, 909, 912, 915, 926, 939, 944, 947: n = A,T,C or G
nnntcaggctcctggatgagccctgcganagagggtggcagcacggagagagctgctggaggcagcagagcaccaaggaaacatccagacatgcgcggcccggcccatccgctcccggaacagcaccaagacgaaatgggaaactacatgtccccaggttcgaggctgcaggggcagactctggtgtgaacaggggggatgtgaccacctaaggaaaaggtcacacctgtcttggtatcaggggctcaagagctctcaaaaatgtaaggggccgacagtcccctgccccaggcctgatcacaactccagggtcatgaggtcagagtaaagtgcagaggtttttaaacataaccaaaatttcaggagaggccaattcttacttgaaagagcaacaccctggggcgctgcttgccattacttcctcatctttagcaacacatttgcttttcaaggtgttccttgtggaaacacacatacacatagacacatgcccctcagatgtcccctgccccctgattagtagaatgtggggtttccacaatgagcagaaactgatccaattttggttaagtttgagaagccctctgaatttgggtggttggcccaatgtaaatacttccgcagagatggagggcattcaaaacaggttctgaaaggatccagcctatcttggactttgttctggaanccanggattcagcnttggccacctgtgccaggcttgcaaggcctggtgtgaacncccaaantggcagcaaaaacaacanacagccnctgcactttggntggaccaacgtttggcctnaacaaatctngcgggttgggatnttcttgntttcncncccaggggaccnaaaacccccntacntgnaataaccntttttttttnnaaccntttanccantgggnttnccnaaaaaacttgnccccttttttttnccaanggnaaaat

SEQ ID NO: 822 - DNA, 587 bp, Homo sapiens
  misc_feature 264, 335, 366, 371, 410, 413, 416, 424, 438, 464, 477, 478,497, 502, 509, 540, 575, 577, 581: n = A,T,C or G
ggcacgagaactagtctcgagttttttttttttttttttaacatttctgaattttattatttttagggaagacacgcagtttcacaagaaacaatgatttttctcaaacaatagaaaaaaaggtctttttgaaaaatccactgtcttagatgaaaagtctacccagcaagcactggggcagttctgagagtagaaaccagtgtggtggaagttacttataggaagttcagtgcagaggtctccacaagtcctgattagttctgnaaggctccattgggccagctcagggtaacagtgggaatgagctcacagacaaaggcaggcaccagttcctntgcccgggatgcaggctggctcactccccangcggntgcatcttgcttcagactcatcaaactgctgctgtccanctncgncatgactntgttgagaacatanaactctgctctctggctttgcttcanctcctggtgggcnnaattctgcttagccttctncactntgaaggntgggtctttaacttttggatttttttttccnggcagggggaaccatgaatggggtacatacccacncngggntttggc

SEQ ID NO: 823 - DNA, 264 bp, Homo sapiens
  misc_feature 1, 4, 7, 15, 17, 35, 38, 44, 53, 90, 105, 108, 115, 117,121, 126, 128, 158, 176, 178, 184, 201, 221, 227, 229, 233,239, 250: n = A,T,C or G
ntcnatncctactangncaaactgactccgccctnagncacctngtggtccanggctgcggagctgcgatacagccttccgcgggtctgntggaaccccgacctntcntggtgtntntccntcccncnccccaacccgccaagggcctgcctttcctnctgggcctttgccagcgntnggccanaccggggccaaaccggnccccgggcacattttaaccnagggcncncttntagaanaaaaccccggntgatgttataaagg

SEQ ID NO: 824 - DNA, 520 bp, Homo sapiens
  misc_feature 7, 15, 17, 39, 60, 81, 98, 101, 110, 111, 138, 145, 174,222, 250, 262, 311, 318, 332, 336, 345, 378, 406, 411, 414,421, 426, 439, 447, 448, 450, 474, 479, 489, 494, 498, 505,508, 510: n = A,T,C or G
tcaagcngcccccantntgatggatatctgcaaaattcnccctttcaccggccgcccgcngcatgtcttattatacaacanatccaacttccctaagnggntcacacatnntaaggtattgttaacaaaataggaaantctattngaactaacaatcatctctttgaatctgcntatcccattaaaagcattttcctcaatattcctcatatcggttatggncaatggatacccatctgagctggttganccctttaaattnattatacttaactttttgaaggctgttatacccaagggacaaacctaancaaccancagatatacttganggtntctcctgtnatttctcagattccaatataccattttgccttnacacctacagcccttaggggcatcctcnttccncanaacaaancattntcactaagacagnctggggtnntncaccaatggctaccaaacctctgnccgcnacccaccgcntaaanggcngaaattnccnanccacacgggt

SEQ ID NO: 825 - DNA, 2064 bp, Homo sapiens
cggtgcgctgagcgccggaggagcgtaggcagggcagcgctggcgccagtggcgacaggagccgcgcgaccggcaaaaatacacgggaggccgtcgccgaaaagagtccgcggtcctctctcgtaaacacactctcctccaccggcgcctccccctccgctctgcgcgccgcccggctgggcgcccgaggccgctccgactgctatgtgaccgcgaggctgcgggaggaaggggacagggaagaagaggctctcccgcgggagcccttgaggaccaagtttgcggccacttctgcaggcgtcccttcttagctctcgcccgcccctttctgcagcctaggcggcccgggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaa

SEQ ID NO: 826 - DNA, 2109 bp, Homo sapiens
tggcgccagcggcgacaggagccgcgcgaccggcaaaaatacacgggaggccgtcgccgaaaagagtccgcggtcctctctcgtaaacacactctcctccaccggcgcctccccctccgctctgcgcgccgcccggctgggcgcccgaggccgctccgactgctatgtgaccgcgaggctgcgggaggaaggggacagggaagaagaggctctcccgcgggagcccttgaggaccaagtttgcggccacttctgcaggcgtcccttcttagctctcgcctgcccctttctgcagcctaggcggcccaggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagcgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagacttt

SEQ ID NO: 827 - protein, 394 aa, Homo sapiens
MVTMEELREMDCSVLKRLMNRDENGGGAGGSGSHGTLGLPSGGKCLLLDCRPFLAHSAGYILGSVNVRCNTIVRRRAKGSVSLEQILPAEEEVRARLRSGLYSAVIVYDERSPRAESLREDSTVSLVVQALRRNAERTDICLLKGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 828 - DNA, 453 bp, Homo sapiens
ggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagct

SEQ ID NO: 829 - DNA, 452 bp, Homo sapiens
ctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccgttgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcag

SEQ ID NO: 830 - DNA, 450 bp, Homo sapiens
ctgacccccctttgtccacagctaagatggcagcagaatgctatgtcactatatacagaaacaagacaacctgaagctaaatggatgccccctgcagagtcaacaggtccagcctcacagtgcacgccctgagctacagcctctcccaaaaggcatcttccccacagcctcaacgccgagcaaggagcatcaagggtttgtctcggttgttttgttctttttacaaactatagatatatacagttgaaaactcaggatttctagccaataaccatagttaccaccaccttacaaataaaaagaaaatgccagaaacatctttaaatgccttgtcacaccaacagcaaagtgcacagagtgaggagaacacgagagtgccttttcattttaaaaatgtttggaaatatgtacaactttgatacagtttcagggtgctccagacacccatgg

SEQ ID NO: 831 - DNA, 395 bp, Homo sapiens
ctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccag

SEQ ID NO: 832 - DNA, 291 bp, Homo sapiens
ctgactcttccatctgtgcaggttgactgaggtcattcctgagttgcagtatgttgagagggtaatatttctgtcttctctaactccccatactcccttgtcttccactctccacttaggagttttttgtgagttatgtccttgttgcttttgcctctttttctttctagccttgattgtgccagaagacaatgtccctattcacacactctttctgcttttctgtgggcaggaacatggaaggggtgctgatggacgtggactgtgagagcgtctaccccactgtgtagg

SEQ ID NO: 833 - DNA, 491 bp, Homo sapiens
ctgtagcttctgtgggacttccactgctcaggcgtcaggctcaggtagctgctggccgcgtacttgttgttgctttgtttggagggtgtggtggtctccactcccgccttgacggggctgctatctgccttccaggccactgtcacggcttccgggtagaagtcacttatgagacacaccagtgtggccttgttggcttgaagctcctcagaggagggcgggaacagagtgaccgagggggcagccttgggctgacctaggacggtcagcttggtccctccgccgaagaccacattattgccgtcccacgtctgacagtaatagtcagcctcatccatagcctgggtcccgctgatggtcagagtggctgtgttcccagagttggagccagagaagcgctcagggatccctgaagaccgcttattatcttgataaatgactaccacaggggactggcctggcttctgttgataccaacaagcagatacctg

SEQ ID NO: 834 - DNA, 308 bp, Homo sapiens
ctggtcgaggtccacgccgcggtaggtgaacttgcggaaggtccgcttcttcttctgctctacttctgccgtgctggagaacatcgaactgaacaagaagagtatgtattcccgtgtgccagagtgccaggtcaccacatactattatgttgggttcgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctgg

SEQ ID NO: 835 - DNA, 472 bp, Homo sapiens
  misc_feature 365, 402, 406: n = A,T,C or G
ctgacatgttaactgtgatgcataaaactcgatcttctgatggggagtaagtgcagaaggtagaaatctccgccccgcgggggcttatctgtactggtagttcatgctgtggtctgcgtttctgccatagccgccttgtgaggactggtaggagctgggagggccactgtagttctggccggaccccggggagttgtagttcgactgtgagtagcctccttgtttgccttggtatgaggagccgcccccagaacctccgccgtagcccccgtgtgaccctgggttgtaggatgccccgcctgagccgtagctgttcccgccgcttcggcctccactaccactgtagttgaatttgctctcgtagntgtagtcggatccgcccccgcccccgggagagttgtngganttcgagtaggagtagctgccttgtccatggttatagcctttctgcttgccctgtggagggccatag

SEQ ID NO: 836 - DNA, 354 bp, Homo sapiens
ccagtgcaaccttcagatagacacatggtgaccagagcccgccaggcttctgcaggtggcagtgtcgagcaagtgtaagatgtctgtgggaaggagaagctcctgaaatgaacgttctgcaaacagaaggctgaggggtcttccaggcatgtccagtcactaggagctgccaccggtgggcttgagtgccaggctctaggctttgtgcagaaagcacccggggcggggggcggtaagggagagcaaaatgggtctctctcaactgcagtcagtgctcctgggaacacggtctcacagacagcacatattctacgtcacagctctagggtttcaaggacttagccatccgacagg

SEQ ID NO: 837 - DNA, 318 bp, Homo sapiens
  misc_feature 282: n = A,T,C or G
ctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagccacattgaagcggacattggcaaccgggtccccagccatgcgcagaaccgtgggtagcatgtgcttggtggtgatgtcctgcccacagacctcagacggcacattgatgcagaagagcgtantcatgcggtgcaggtagttggggtctccggacatgg

SEQ ID NO: 838 - DNA, 277 bp, Homo sapiens
ctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaaggcacgtgccatgcgccgccggctcaacaagcacgaggagaacctgaagaccaagaagcagcagcggaaggagcggctgtacccgctgcggaagtacgcggtcaagg

SEQ ID NO: 839 - DNA, 276 bp, Homo sapiens
ccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagagg

SEQ ID NO: 840 - DNA, 453 bp, Homo sapiens
  misc_feature 387: n = A,T,C or G
ccttctttgccatgaccaagctctttcagtccaatgatcccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactanggctcctgtaccatgtgcgtaagaatgaccgcctagccgtcaataagatgatcagcaaggtcgcac

SEQ ID NO: 841 - DNA, 142 bp, Homo sapiens
agcctctctagtggcagagcagctcacactccctccgctgggaacgatggcttctgcctagtacctatccttgtgtttctgatgcagtggtagcattggttcaagttctctcctgctgtggtcagagttgcttcgatgttgg

SEQ ID NO: 842 - DNA, 83 bp, Homo sapiens
cctaaaagcagccaccaattaagaaagcgttcaagctcaacacccactacctaaaaaatcccaaacatataactgaactcccc

SEQ ID NO: 843 - DNA, 482 bp, Homo sapiens
ccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttgggggtatggtgcctgtcatacccacctgccaccctg

SEQ ID NO: 844 - DNA, 534 bp, Homo sapiens
  misc_feature 495, 508: n = A,T,C or G
ccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagcggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagacttttgaacaaaggctaaaccaggccattgaacgaaatgcatttttagaaagttgaacttgatgaaaaaggaatctttgttggtctctgtacagaggttnaaggatgaagcangagatttaaggcaagaactagcagtt

SEQ ID NO: 845 - DNA, 175 bp, Homo sapiens
tcgacctgtggcaaatgtggctaccctgccaagcgcaagagaaagtataactggagtgccaaggctaaaagacgaaataccaccggaactggtcggatgaggcacctaaaaattgtataccgcagattcaggcatggattccgtgaaggaacaacacctaaacccaagagggcag

SEQ ID NO: 846 - DNA, 179 bp, Homo sapiens
cgcgtggacagttgcgaggggtctgtgtgaaggcacttgtcacgagcttcaatactgccgccgtcccaggatgggagaactgcgcagcaggaagggcacttctgaaagcacagtggagagatcgctggagcgggcgttctgggcaggaggaagcacagacggcaggcagggtggactgg

SEQ ID NO: 847 - DNA, 410 bp, Homo sapiens
ccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccagg

SEQ ID NO: 848 - DNA, 557 bp, Homo sapiens
  misc_feature 508: n = A,T,C or G
cacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaaccagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggnggacttccagcttttgattgaaagtcctagggtgattctatttctgctg

SEQ ID NO: 849 - DNA, 525 bp, Homo sapiens
ctgatggtttggaaatgagagaactacagtggtgaagagaccaggaggcagctctcagtgaaaccaacattgcggatgcccttcgtgagccttctcagtcccagcaggaagcccacaacactggcctccccagcctgcctgctgacaacacctaggcttactttatctaaaatcagagtgtaccaggtctgtagcagaaaataatcaactaaatgtcagggacctatgagtcatttaaaacaaaagaggaagtgaaagccattaggcaagctatgtgctgggctgctaacgtagcccctgcagggaggggtcaggagcgcgctgcagtgagccttgggtctcgcaggcccagccctgctgcaaggagccagggcacccaggaaacatcagcacacacacacacagggaccctcccttcatgtcacttgttttgctgccctaaatggcttcttgcaccctaacccctgatcctggaagaaggcagagagactggcccgtacagagacctgcaattctacgcaagct

SEQ ID NO: 850 - DNA, 384 bp, Homo sapiens
cctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcag

SEQ ID NO: 851 - DNA, 423 bp, Homo sapiens
ctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaagatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtccttctgtaaggtggacttccagcttttgattgaaagtcctagggtgattctatttctgctgtgatttatctgctgaaagctcag

SEQ ID NO: 852 - DNA, 413 bp, Homo sapiens
ctgaaaacagtgggaggccagatgctggcatcttccagacgggagcatagccatggtcactctagccgatgtctcctggggctctcaggcggcaaggaccagatgcaccactactgtccaatcccagttttacttagagccacctccttttttggggccattagtccttatttcatgccagattttcactagcggctccctgttcttccaaatcaattcatgaccgtaagtaacataccatattccaaaaagagctcccccaagatgtgccgcatgatcaaaaaatttccatcccaggatcattcctgctgtatccatggcgataatggctttcagggcattccctgctgtgaacgtgaacatcggaaggaaaataatggcaagcctcccttctgggatcttagtgcagacag

SEQ ID NO: 853 - DNA, 288 bp, Homo sapiens
atctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggggg

SEQ ID NO: 854 - DNA, 427 bp, Homo sapiens
ccaagtgagatcagccctcaagggcacatgccaagggcagagcagcccatgtagacagcttcggagggcatgggggtgtagggagttcggggtagctcctcattaactatttgttgggtgagtaaaggggtgaggctcagtggcaggtacctctgcaatgacaagctgcctcccctctatgtgtttagcatatgttattagaacgtgtccgacacccctaccgctgccatttgggccctttaataaagccaagtagagaaatctggcaataaaaggcaaatgtaagcatgctttctttaagacgcatcataaatggttttctttaagtgaatggaagagtttgacagagatacacctttgtaagaaaacattaagaatgctggctgactgtggtggctcacacctgtattcccagcactttgggagg

SEQ ID NO: 855 - DNA, 311 bp, Homo sapiens
ccagtattcctggaggatataacactgacatcagcagggttttcaatggcaacaattgcacgagctgccagcagaagcttctcccaggtcctcttgagatttatgatatagatgccatcacttttccttttatagatgtactgttccatctggaagtcaagattggtgccacctaagtgggttcctgctgcaaggaacttaaggacatcctcctccttcatttgcaggacatcaagggctccggacattgtgaaagtttccctttaagttacgacgggaatccagaacaacgccgtatggacccctctgca

SEQ ID NO: 856 - DNA, 328 bp, Homo sapiens
cctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtctatctgatgctggggtgcggaagatgacagcaccagttcgagtgatgaaaagaggtatccaatgcctgcatctgtgatctcagggttacatgataagtctaataatgttagattctcaagg

SEQ ID NO: 857 - DNA, 502 bp, Homo sapiens
  misc_feature 473: n = A,T,C or G
ctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagangtaaggttgggctggtgctcacagacctc

SEQ ID NO: 858 - DNA, 411 bp, Homo sapiens
cggccgaggtccttaatagttaagttacagctaagaatgtcatgtcttgggttggaattttcatttttagcaccgttaatgtattcacttaaatctatgttagcaccttgtctccaggcagaacaacaaaccatccaaacattttaaacattgggggaaacacgaaggggagggttaaagacagaatccagtactgtggaaggagtggatttagatcacaagatccttgtcgatatccttctgcttgatgccgaagcagccggcccactcatccagggcgatgtacttgtcattgtccaggtcacaggtctcgaaaaagcgggtggtgcaatgctccatggggatgaggggagcacgcagtggagccagctcggtgtgggagaggtacccgtcaatggggtgctggtccag

SEQ ID NO: 859 - DNA, 232 bp, Homo sapiens
aaatcacagagggacttagtattccattaatgcaaatggaaacattaagttcatcatcagatgataaaaggaaaaaaaaaacctgatactcatctcaaaagacgcagagaagacatctgcataaatccagtacctattattatttcaaatttaaaaacttcttcttttttaagagatagggtatcactatgttgcccaggctgatcttgaactcttggcctcagatgatcct

SEQ ID NO: 860 - DNA, 235 bp, Homo sapiens
  misc_feature 230: n = A,T,C or G
tgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaatnctttt

SEQ ID NO: 861 - DNA, 457 bp, Homo sapiens
ccaaaggaaagttggaaggcaactgacagattctgccttttaggtacttgaactggcaggaaatgcatcaaaagacttaaaggtaaagcgtattacccctcgtcacttgcaacttgctattcgtggagatgaagaattggattctctcatcaaggctacaattgctggtggtggtatgttaacttctaacattttaaaaaatttcttcagaggaaggaattttttgctgcttttaattagtttttccaggagaggaaatttaagtatattttcaatgatggaagtatggttgtatcatgaaatttgatttatatgtataactcaatgaatttttacctcatacttgagctgcatgtttttaaagatacctttcaagttgaacagtatacactttcttggtttcaaatactgtgattttttaaaaaatcttaagtagaattaattcctgtcactcccc

SEQ ID NO: 862 - DNA, 561 bp, Homo sapiens
ccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccctcgaaaagaaattgtccttgaagcttgtatctgatatcagcactggattgtagaact

SEQ ID NO: 863 - DNA, 291 bp, Homo sapiens
ccatagctgtcccacctatggttttaaaaacagactgtaacttgatcttctgaaatccttctcgaaccacaactcgttctgttaaagaaatcctaggaaagaagtcctactgatattgtcgatagtctccaaaaggtgaggaaggtaactgagttgaaggcaactgggaggggtcttctgcaaactgaggaccattggaaaactgtgcagaggcaaatcttgtcaacaagataccagctccttcaattaaagctaggagaatgccacccattgcggctgacccaaccatgg

SEQ ID NO: 864 - DNA, 265 bp, Homo sapiens
ctgaacttttccacctggagtccttgggaataccggacgtgatcttcttttataggtccaatgatgtgacccagtcctgcagttctgggagatcaaccaccatccgcgtcaggtgcagtccacagaaaactgtccctggaggtttgctgctgccaggaacgtgctcagatgggacctgtgatggctgcaacttccacttcctgtgggagagcgcggctgcttgcccgctctgctcagtggctgactaccatgctatcgtcagcag

SEQ ID NO: 865 - DNA, 144 bp, Homo sapiens
cctccacctgcgttttgatctagatgagcatattgtccatctcccacagcttgctccggttccgcaggtacgcccgcccgtgctcgcgcgtcagcgacgcgatgtcctcgcgcatctcgttgatgaccgggagcagaaactgct

SEQ ID NO: 866 - DNA, 241 bp, Homo sapiens
ctggctgtaagtagcttcatagcaccagtctttgagaatgtcaagctctccagaaatcatggcctccaggacattggggatgatgtcgttctcgcactgtttcagaaaccggtccttgtcaaaggccgggtccacccggaggatctccgtgagcacctccgacatctctgtcttggagaacaggccccccagcaagtcggtgaccttgtccgtaagggcccgggatgcccggatgaacgcg

SEQ ID NO: 867 - DNA, 364 bp, Homo sapiens
cctgggcccgctgacttcagggtgaggccacagctactgcagcgctttttatttatttatttatttactgagatggagtcttgctctgtcacccaggctggagtgcagtggtgcaatctcggctcactgcaacctctgcctcctgggctgcagtgattctcctgcgttcaagtaattctcctgcctcggccttctgagtagttgggattacaggcatatgccaccacacttggctaatttttcgtatttttagtagaaatggggtttcaccatgttggcgaggctggtctcgaactcctgacctcaaggatcctcctgcctcggcctcctaaggtgctgggattgcaggtgtgagccaccacgt

SEQ ID NO: 868 - DNA, 472 bp, Homo sapiens
ccaccagtccacagatgtgactggtaagggatctagtaacagaggatggagttgggcagaatattatcctggatgatatgcacccagcactaggatacacctttcattagaatgaagagaacagacaaagccctcagaaaagatacaaaggcagagacattgattagaacattatctcataacagaggtggggccattacccaccattattgtaaaataactgtaactaaccaaaacacatacaggcttctttaatggagttaataaaactatggcacattgggaatcaggggcagaggtactgttcccagacggaaaactgggataaagggagccatgctgacagggccttattccagtctaggttgttagaaaggagccctagcccagaaatgacagcaaatagccataatcattatgtggggctgaaccagaggaagccaggctgagccaagaagctggaagtatcttg

SEQ ID NO: 869 - DNA, 368 bp, Homo sapiens
cctttcttgtaagtgaagaaaaaggaatgcagcaaagaagagttcgacattggagtccttagttccatcaggatcccattcgcagcctttagcatcatgtagaagcaaactgcacctatggctgagataggtgcaatgacctacaagattttgtgttttctagctgtccaggaaaagccatcttcagtcttgctgacagtcaaagagcaagtgaaaccatttccagcctaaactacataaaagcagccgaaccaatgattaaagacctctaaggctccataatcatcattaaatatgcccaaactcattgtgactttttattttatatacaggattaaaatcaacattaaatcatcttatttacatgg

SEQ ID NO: 870 - DNA, 411 bp, Homo sapiens
ggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcgggagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattgg

SEQ ID NO: 871 - DNA, 385 bp, Homo sapiens
  misc_feature 13, 14, 15, 27, 108, 113, 159, 199, 215, 221, 229, 245, 258,260, 277, 284, 293, 309, 311, 325, 339, 350, 374, 377: n = A,T,C or G
ttttttttttttnnntttttttttttnaaagattcactttatttattcattctcctccaacattagcataattaaagccaaggaggaggagggggggtgaggtgaaanatganctggaggaccgcaataggggtaggtcccctgtggaaaaagggtcanaggccaaaggatgggagggggtcaggctggaactgaggancaggtgggggcacttntccctntaacactntcccctgttgaagctntttgtgacgggcnanctcaggccctgatgggngacttcncaggcgtanactttgtgtttctcgnantctgctttgctcancgtcagggtgctgntgaggctgtanggtgctgtccttgctgtcctgctntgngacactct

SEQ ID NO: 872 - DNA, 184 bp, Homo sapiens
  misc_feature 17: n = A,T,C or G
cttccttcggtctttantatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcag

SEQ ID NO: 873 - DNA, 397 bp, Homo sapiens
ctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaagg

SEQ ID NO: 874 - DNA, 156 bp, Homo sapiens
ccagaagaacactatgccatggttgcactgaattttgtgcctactctagggcaaacagaattacaatcgaaggagttcctatctatctgtaaagaagagaacatgaaattctgttggcagaagcagcattttgaagaaataaaaggttcactgcag

SEQ ID NO: 875 - DNA, 512 bp, Homo sapiens
  misc_feature 504: n = A,T,C or G
ccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaagtgacttgatttaagggaaaaaatgactggctatattcagtcagatatggcaaagagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttaatagattgttcagaagttttaatttatgatgggtgtggtggctcatgcctgtngtcccagc

SEQ ID NO: 876 - DNA, 199 bp, Homo sapiens
cctgtgccgggccccagggctggcagccaccagctcctcttccaggcatgggggacaccctgacaggatccggaagtctccatttacccaaaaatgcaagagccatgatcagtcatggcgacactgcaggcggtactgagtgaccatgtccagtccggctccgtccctcccacacgggggacaagcttctccgaggagg

SEQ ID NO: 877 - DNA, 486 bp, Homo sapiens
cgcgtgtgctgctcccttctgccaggagcccactgcttttgcacacaagctgcattttgcgcattgactcaggtcccagttgctcttcatatctccgtgaatgattggagtgcaaagatactgttctgagcgcttcccgttttctgaaagccatgtctctcaggcatgcctcgcttagttggcgatggggttggttgactgttttcgcttttttcttcttctcttttcttcttcttcttctttttttttcttttccttttctccccctcccaacgccactgacaagaaagcactaaagatgcaggttgtgcgatcaccctataacataaggaaaagaacaggagaggttaatttgaacgtgtaggctagtggtagagggagatggaggtctggggaaagagtctgtcaggtagacatctcttttaacatgtcccagtattcggttcaccagtatctctgcacctcactactacccttcactccttg

SEQ ID NO: 878 - DNA, 363 bp, Homo sapiens
cctgggcccgctgacttcagggtgaggccacagctactgcagcgctttttatttatttatttactgagatggagtcttgctctgtcacccaggctggagtgcagtggtgcaatctcggctcactgcaacctctgcctcctgggctgcagtgattctcctgcgttcaagtaattctcctgcctcggccttctgagtagttgggattacaggcatatgccaccacacttggctaatttttgtatttttagtagaaatggggtttcaccatgttggcgaggctggtctcgaactcctgacctcaaggatcctcctgcctcggcctcctaaggtgctgggattgcaggtgtgagccaccacgtctgg

SEQ ID NO: 879 - DNA, 365 bp, Homo sapiens
  misc_feature 357: n = A,T,C or G
gcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccggaatgctggagatctctggttccccggggagtctgagagcttcgaggatgcccatatggagcacagcatctccaggagcctcttggaaggagaaatccccttcccacccacttccatccttntcctcctg

SEQ ID NO: 880 - DNA, 431 bp, Homo sapiens
ccatctcccctcaccccaacctggataaaatgttacactacccactaatataaccactgacacacaaaccaagctccttccagtttaacattgaacatcaatctacatttccagtgaatgagctaaacttatgagcaggccattcaacttttcatgatacatttagtgctcagaaatggttgattccattagcctgccctatagctcaggtggcccaagatggagcctatcatcttccttggggtgtttggtgtttccaagtaggagcataaaaaggataccgtcccctaccccaccaccccatcccacataccctcactggcatccaggagaccagcagcaggctcaagaccccaaatgttgggcaccacaaataatgtgatatgtgccaggagcacggggggtaggggtgaaagagaaaaacaataagg

SEQ ID NO: 881 - DNA, 335 bp, Homo sapiens
ccacagaggtggtattacaaaatatacaaagtggtttctttctttacatttcatagaagaagcctgcctcatttccaaatgagagcactagaagcacaaatcatgcagaccatttactatataacttatgaaaaatgctgtacagggctgtgactatagatatagagtatttggctctgtttgggaattgatatctacaagggggagggtcaggggaggactgtctgatatcctgacttgctgggatggtggagaagctgggatgggggaggccccaatcttgctgcacggctacacccactcctcctttcctagataaggctggagcgcactgg

SEQ ID NO: 882 - DNA, 353 bp, Homo sapiens
atgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcag

SEQ ID NO: 883 - DNA, 193 bp, Homo sapiens
ctggcagagaagaatggctacgtgactgtcagtgagatcaaagccagtcttaaatgggagaccgagcgagcgcggcaagtgccggaacacctgctgaaggaagggttggcgtggctggacttacaggccccaggggaggcccactactggctgccagctctcctcactgacctctactcccaggagattacag

SEQ ID NO: 884 - DNA, 461 bp, Homo sapiens
ctgaagaaccccatcagcgggctgttagaatatgcccagttcgctagtcaaacctgtgagttcaacatgatagagcagagtggaccaccccatgaacctcggtaagagaccacccaggaactgtacctagggttggggtcaggtgcttttgctcctgacgcagtcttggctgatttgtgagcagtgctgtttggtggcgcctatcttttcctccttcccttctgccttttagctaaattccccttgattggccctttctccagatattgagcagggaatatagaccttggaccagccagaatcttggctgaacaagggggaggttgactctgttggctgtaatgaagcttctttagaaatgattggttttggccgtacgcggtggctcatgcctgtaatcccagcactttttgaggccgaggcaggcatatcacgaggtcaggagtttgagaccagcctgg

SEQ ID NO: 885 - DNA, 266 bp, Homo sapiens
  misc_feature 14: n = A,T,C or G
ctgcaatgcttcancacacttcagcaccgaggctgggcatgaggggtccgtcaccaccacatcaaatacccctaaagcaatatctttgttatgggcacttgaatggtgctgcttcacagaggctgcaccaccagtcatgaggatctcagaccagagctccaggaagttctgctgttggtctgataccaagagtaccttcagattctggaaaggattttcacggggttgccagtccagaattctttgctcctcaaggctgtacccag

SEQ ID NO: 886 - DNA, 402 bp, Homo sapiens
cgcgtggtttccgattgtttgatagtatttactggagagatcatagaaacgactgtgaaccgatgtcacaccaggaaggttgttgagcatttcttcaacatcttcaattgtttcctttgtaacctgtaggtccccgatgtttaattttagagctccaattgctgttttacacaggatcactgcctcatcattacttttcaccttctcacgagtcttttccagaaaagtaagagccacattaggatcagtcatctgtctaactacatgaagaatgatttccacgagggacaaagggttcaccctgtgttcaaattcactgataaagttttcataaagcttaatgagaccatctccttgggcaaagcacggatcctgcacaaaatcaagcacctgaagtgtcag

SEQ ID NO: 887 - DNA, 342 bp, Homo sapiens
ccaaagcgagagcattggcagtgaattgcagacactcttccttggtcatgccttcccggtaggtagcatcaacatagccatagatgtaggagctcccggagcctccaatggcaaaggactgccttaccatcataccccccataggcactgagtacacctgccctccttcttgagggtcccagcctgcgatgatgattcccgccatcaggtcttcccggtatcggtaacacatctccttaaagaggctggctgctgtgtggaccagtggaggctcattcagttcaatgctgtggaaaccgagctggtaggtgacagcatcagctactgcctgggtatcagcag

SEQ ID NO: 888 - DNA, 228 bp, Homo sapiens
cgcgtcggccaaggctgctgctgttgctcctccaaagaaggttggcttcaaggccgtgtccagggacccacgagcagaggcactggggggcaagggatctccaagggggcaagggatccctaaagggggtagctcacaggtgagggggtttagggcccctctagggagcgcctgaggccatacattcaagagtgtccctggtgaggcccagggaagagccaggactgg

SEQ ID NO: 889 - DNA, 378 bp, Homo sapiens
ttggcttttctccccttctcatcctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttaggaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccagg

SEQ ID NO: 890 - DNA, 215 bp, Homo sapiens
ccattttggagtgtgtccattgggtagcaatgtggaaaccaccagggcctttgtggagaaaatggagggggttgagggagtcccaggaggggcttatttgagggcctttgccacttgctcataggcgagctcgatctcctcatcatctggacaggtggaagcgaattcttcccgggcgtaggcattgctcaagtaccgatgcactccccggaagg

SEQ ID NO: 891 - DNA, 412 bp, Homo sapiens
ctggtcaagttcaacagagccttggctgaccattctatggctcaggcacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaagg

SEQ ID NO: 892 - DNA, 472 bp, Homo sapiens
  misc_feature 85, 169, 171, 181, 201: n = A,T,C or G
ttttttttttttttttttttttaattactaccttttattctaatgtgaaccatggccctgaaagctgataacaagcttggctgancagagggaactaggggtcggcagaaaggattatgggtggaaaacattggctcttccttggggagtgatgctggggaaagggaananagtggctcancctgcaggtaaataggctanaaaagccaaggccaaaggctggaggggagaggacagtcagcatgtccagcctggggtctgggtgtagggttatcccttctccctgtgccttcccatctcgtccatgagcctaggtcttggagccttgtgttggaggctgctgtgatgtcaggaacggggatctgtctagcttttggccacttcctgggacctcacgcccctgttgacagatggagattgggcagcagggccttgctgcgttgttatctgctgttccgacttggtttgtctt

SEQ ID NO: 893 - DNA, 477 bp, Homo sapiens
  misc_feature 436, 447, 449: n = A,T,C or G
caaagattcactttatttattcattctcctccaacattagcataattaaagccaaggaggaggaggggggtgaggtgaaagatgagctggaggaccgcaataggggtaggtcccctgtggaaaaagggtcagaggccaaaggatgggagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcangcacacaacanangcagtttccagatttcaactgctcatca

SEQ ID NO: 894 - DNA, 289 bp, Homo sapiens
ctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagagtgctcgaggattgcccggaacag

SEQ ID NO: 895 - DNA, 179 bp, Homo sapiens
  misc_feature 14: n = A,T,C or G
ctggatgggtccanacaaagtggaatccctggaacctttaactgagcagtgaaggtcagtgcctcagagcctgagagatgaacaggaccagagagagaggtgggcaggcaggcacaaggttatgtcttcctcagactcggaaccctgctcttctccaccatccagacgttcagctacag

SEQ ID NO: 896 - DNA, 557 bp, Homo sapiens
  misc_feature 367: n = A,T,C or G
ccactcactgctgggacccaggcacctcccttctccatcctctctggattgtcagtaatgtcctggaacagaagcctgtgggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcacnctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgac

SEQ ID NO: 897 - DNA, 495 bp, Homo sapiens
ctggaatctcctttgcaatcccatctgataagattaaaaagttcctcacggagtcccatgaccgacaggccaaaggaagagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttt

SEQ ID NO: 898 - DNA, 406 bp, Homo sapiens
ccacgactgcatgcccgcgcccgccaggtgatacctccgccggtgacccaggggctctgcgacacagggagtctgcatgtctaagtgctagacatgctcagctttgtggatacgcggactttgttgctgcttgcagtaaccttatgcctagcaacatgccaatctttacaagaggaaaccgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgacggaaaaggagttggacttggccccggaccaatgggcttaatgggacctagaggcccacctggtgcag

SEQ ID NO: 899 - DNA, 277 bp, Homo sapiens
cctaagagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtatggggggagtg

SEQ ID NO: 900 - DNA, 389 bp, Homo sapiens
ctgttttgaaatatttactgttattaaaacttgcttcaagggaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtctttatccatca

SEQ ID NO: 901 - DNA, 453 bp, Homo sapiens
ctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcag

SEQ ID NO: 902 - DNA, 293 bp, Homo sapiens
cctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccattggcctctacatgcccgctgtcggcttcttgctcctggtccttggtctcaaggctctggaactgtggatgcag

SEQ ID NO: 903 - DNA, 228 bp, Homo sapiens
ctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcag

SEQ ID NO: 904 - DNA, 388 bp, Homo sapiens
ccaagcgctcagatcggcaaggggcaccagtcttgatctgcccagtgcacagccccacaaccaggtcagcgatgaaggtatcttcagtctcccccgaacgatgaggcaccatgacgccccaaccattggcctgggccagcttgcacgcctgaagagactcggtcacggagccaatctggttgactttgagcaggaggcagttgcaggacttctcgttcacggccttggcgatcctctttgggttggtcactgtgagatcatcccccactacctggattcctgcactggctgtgaacttctgccaagctccccagtcatcctggtcaaagggatcttcgatagacaccactgggtagtccttgatgaaggacttgtacaggtcagccag

SEQ ID NO: 905 - DNA, 272 bp, Homo sapiens
  misc_feature 14: n = A,T,C or G
ccggagcccacggnggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccag

SEQ ID NO: 906 - DNA, 525 bp, Homo sapiens
ctgtgcacccgagtgtcctttcccccctaagctggcacataggagcaaaagttcactaaccctgcagtggaaggcaccaattgacaacggttcaaaaatcaccaactaccttttagagtgggatgagggaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtataaattcaggctgactgcttct

SEQ ID NO: 907 - DNA, 365 bp, Homo sapiens
gtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccag

SEQ ID NO: 908 - DNA, 608 bp, Homo sapiens
  misc_feature 594: n = A,T,C or G
cggaggtgcctcagccatggcatggatccctctcttcctcggcgtccttgcttactgcacaggacgtgcggcctcctttgaggtgacccagccaccttcaatgtccgtgtccccaggacagacagccaagatcacctgcactggagataggttgggggatgaatatgtttgctggtatcaacagaagccaggccagtcccctgtattgataatatatttggataacaagcggccctcggggatccctgaccgattctctgcctacgcctctgggaacacagccactctgatcatcagcggggcccaagttatggatgaggcttattattactgtcaggcgtgggacggcagaactgtggtgttcggcgaagggaccaacctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggncagcagctatctga

SEQ ID NO: 909 - DNA, 513 bp, Homo sapiens
ctggtctcaaactcctcacctcaactgatccgcccaccttggcctcccaaagtgctgggattataggtgtgagccaccgtgcccaaagttaagtatttttgatcaagtgttttgtcttttgtgcaaggcatttgtggctctgtcatagcagaggaaaacaaaacatgcctatcaaatgaatcaagtccgacctcttctcatattgagcaactagaggtctaggaacatttcccctacctgtcattctcatctggcataccaggtgtacatactccttcttattctcctctgttaccaagatgttggccccattgggtttgaggtcacgaactccacaaactccaaactcttggacctcagtgctgaaggtgaggtcatagcctagtgtggagacatcattttccagcagataaaccagaccttggtagaagtggtaatcttcactctccatatctgtatatctgactgacttgcccaagatgtgtttgtaaaaggatcgagtaaagtagcact

SEQ ID NO: 910 - DNA, 272 bp, Homo sapiens
ccggagcccacggtggtcatggctgccagagcgctctgtatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccag

SEQ ID NO: 911 - DNA, 263 bp, Homo sapiens
cctgcaggtacaaattgaccaggctgttgacggctgcctccacgtcggtggaataattctgacgaatctgggagctcatggttggttggcaagaaggagctaaccacaaaaacggtgctggcaggtcccagaagcaggagatggccgagaagatggtcccggaggttgcaagcggagaggaaatcggagggcggtcggaggctggaagagagtccccggatctgttccgtccaaacactgttgaagcaagagacagacccgcg

SEQ ID NO: 912 - DNA, 470 bp, Homo sapiens
ctgtgagcaccagcccaaccctacctctttaaaaagaaaaaacacaagtccactctgaagtcagcctctgtaacctccccacaagaaaaccgttttacatcagtcactaaccaaacaaccaacagtgcttcaacacagaaagtaaagcattatccagggcttggactgtctttcaagaaagccccaaatcccctggcaggaggaagtcacagcagtgaagccccatcccaggcccagttgttcccacgaaacacaccacgtggagacccagcatgactgccgactgattccaagtccccaggagggctttattttttcttttcaacatcctgttctgcggcttccttggcactttttgcccgtatgccgaagagccgggcgttggcacgggccatacggagactagcgaaggctttgaaattcttctcttcctcagtgatgactcgagctttctccttcttatagacgtt

SEQ ID NO: 913 - DNA, 426 bp, Homo sapiens
cctggacaccataaggctggtgggctttcagaattgtgttaggggggcaggagtggcaggttcctgaatctcggtcaatatagtaaccagcaggacaagaggtgcaggaggagcccacatcagaggcttctagggcacagggacggcagtaggaggccacgccattcataacattggtgacattgatggagtagatcttggcaacgtcattggtgtacttcctgcttgcctcatgaaaagtggtcctctggaaggcccaggtgaggctcgtggtagtgttctcctcaatgatgtaggtataggactgtttgcctttggaacctttccacgtctccacaggagtgttggtcctagaattcacacccaccatgaagtagagctcacagttcacagaacagagggtctcaaagacaaatgtgattctgg

SEQ ID NO: 914 - DNA, 252 bp, Homo sapiens
ccaagctgggggtgcgcacatgtggaagaactggaggcccggtgtcatgagcagaggctgtaccctagatgcccgccccagtgccagccaacccaagacaggagaaagagtttggcagtttcgcctctgaggaatacatgcctggccctcctgtgaggtgaggcggtaggggggaaggcgcaggctccgaagtctgagggcttgccggagggggagtttctgagccttttgcatgggtgcatgccccctgcc

SEQ ID NO: 915 - DNA, 234 bp, Homo sapiens
ccactgggactttggcttcctgatgccgattgtggatttctgctgcaaagacagtgatgttgagccaggctgtttcctctctatccagaggttttgtagttttaataaaaccatcctctggattaatagtgaaaaatctgtcgaggtcagtgtgacgatcgatggaataccttatcgggctgttggcagcatcagggtctttggcatgcactctcccaaccacggtgccagcag

SEQ ID NO: 916 - DNA, 366 bp, Homo sapiens
  misc_feature 14, 338: n = A,T,C or G
ccattcagtctcanttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgatnaaaaaaaaaaaaaaaaaaaaaaaaaaaa

SEQ ID NO: 917 - DNA, 492 bp, Homo sapiens
ggcacagcgagggcagcatctggaggagctctgcagcctccacacctaccacgacctcccagggctgagctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggtcttccagcttttgattgaaagtcctagggtgattctatttctgctgtgatttatctgctgaaagctcag

SEQ ID NO: 918 - DNA, 557 bp, Homo sapiens
  misc_feature 527: n = A,T,C or G
ctgctcctgggtaggcgtgcgggccatatcgtaggggtaggatactagccgctcgccgccgttcagatttgctcccagcacgaaggggttcttctccatccaggcaatgatggcccggacctccgtggataccgtggcatctggcgaaaggtagcgttcagggatgggcaagttattgttggggacccggtaggggacccatttcctctcctcagctccccagagcacagagttgagatccgggaaatcttcaaagatgtcaaagccctcctcagtccacagtcccagcgcccagttcccaaactctgagcccatctgcgctgccacctcgtagccatcagggttcagtgagggcaccaggtggatgcgtgtgtcctgcaccaggctgcgcacacgtgggttcccatcgcggtactctcggcacaggtactgcatgagcagcagcaacagctctcggcccagcacctcgttgccatggatcccagcagtgtagcggaactcgggctcccccagttcatgctccccanggttgtctgagatctccatggcatagatct

SEQ ID NO: 919 - DNA, 407 bp, Homo sapiens
ccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcatcacagaaatagcaaagttcttgaaagtctcccaggggcagttggttgtaatgcagcctgagagattccagtctaagtatgagccccggagccacatgatggacgtccagggctccacccaggactcggccatcaaggacttcgtgctgaagtacgccctgcccctggttgg

SEQ ID NO: 920 - DNA, 340 bp, Homo sapiens
  misc_feature 14, 15, 304, 318, 319, 325: n = A,T,C or G
cctcttgggcagcnnagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcnaaaaaaaaaaaaannaaaaanaaaaaaagcttgtac

SEQ ID NO: 921 - DNA, 571 bp, Homo sapiens
ggaaaaataattttattcctcaaatgatcagcacattcagaagcaggacagaggagctctgatgacatctctgggggactcaaagcggccctcattttctggtattttcccaggtgattctcttccaacctgtgagtcctgctctctttcctcccatctgaagtttgagacatcctctgccacaaggaaagccaccaataccagcccaaagagccaccagagaggaaccaaaccacatgcatcaagttataggaaggatgcaagaagggaaattaggaaggaaagggaggagtttagttggcattctggggcatgctaacatgagggcgatggtctctctccaagtcgctggacatatcccttttctttccaggtgctccaactccaattgcagtttgggggaacgtgtgaaacttgttgaagtcctgcgtgtatgtgcccagcatgcaagtactcagattaccgcaccgcttagatctggggctgtccaggctggagccctctctctcttgctcctgctccagctcactggccttcatctgcacatagtcctgcaccagtgcagccagca

SEQ ID NO: 922 - DNA, 262 bp, Homo sapiens
  misc_feature 7, 12, 125, 198, 208, 214, 231, 253: n = A,T,C or G
gcccaanacatncaggtcacagcagattcgggcacgtgtggaagaaggttggatgatgtcatccacaaaccctcgcactgctgcagggaaagggttggcaaacttctcgatgtactctgcctgancagcttccacattctcatgccctttgaagatgatctccacagcgccctttgctcccatgactgcaatctctgnggtgggccangcatanttggtatcaccacaaangtgcttagagctcatgacatcntaggcacct

SEQ ID NO: 923 - DNA, 234 bp, Homo sapiens; identical to SEQ ID NO: 915

SEQ ID NO: 924 - DNA, 152 bp, Homo sapiens
ccaggattgacaggccatccattcacagccaggagatgctgggccagttcctccaagaggtctccgtcatggcagtgatgaaaacctaacagggtggccccctgtgccagctcaggtgactggagcccgagggcctgacaggttcccagcag

SEQ ID NO: 925 - DNA, 400 bp, Homo sapiens
caatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattgg

SEQ ID NO: 926 - DNA, 521 bp, Homo sapiens
ccacgtccctattttagaaatgagaggagtgactgcacacaggaaaaatgccacttttagcaattcaaagtggaaaaacttcttttatataaaaattatcccaactcccaccccttggctctcagtgttgcatctcccacagaggtaaagttgtgccattttcccacggctttaaacaaagcaaaacaaaaccaccaatcctaataacccccctccctgccccgtctccacgctgtgcggagagggctctagcccctcagtcggacttctccttctccttcatgtgcaagaagacgatgctgaagatgaagagccccagcatcatggagaaggcgctggcgtagtaggggtaggccgaggggatgaagcgctcatactgcgtgtgctggagtggccgcacggatacctgagtggaagagtacaggtgtgtgtagcctagccggttgtaatccactttaaactggaatacaccatacacgtcgggcaacttgaactgaacactgtatttgccacctttcttc

SEQ ID NO: 927 - DNA, 520 bp, Homo sapiens
ccaggctagtctcgaactcctgacctcaggtgatctgcctgcctcggcctcccaaagtgctgggattaccggcgtgagccaccatgcctggccttacattttttaaaatgagggaacaaatgaataaatgaccaccatgttaggggctggctctgaacagaattgtaaagtgggccaagcttgctctcaaggtcaccttaagcccacggttgctgtgtcctgccctctcagggtcatttcccagcctccaggcacctgttcacagaggctgcatctggcctcgcctccacccctccatcctaaggtgctccgctgacttagaacaggacagtcagggagagaatgtgtctcaggagggtggagtcagatgatcacggccttcctggcatctgaggggatacagcttcgggtagcaaagtgtgattttccctgagccccaggaaagcttggccttggtcagaatacattgaaccctgagggccagagagtccctggggcaagctctgagagggaggacctc

SEQ ID NO: 928 - DNA, 492 bp, Homo sapiens
ctgagctttcagcagataaatcacagcagaaatagaatcaccctaggactttcaatcaaaagctggaagtccaccttacagaaagacaaaaagaaacccctttttatatcttaacaaagcaatagctctcaagcagcagagcatctcgaggaagaaagcttgcccggtcgccatcccatcatgccagagcgtgcagtgtccacccttgactacgctggggaattgctgattttttgaaaaagcttaacttaacaatttctgatgtctatcttttagagttctgtatgttcccattttttattcttctgaattttgaattgcaagtagctgtaaaatccaatctctgagtgcatgggggtgggtgtgaggcggggctcagcttcaaccccctgtcctgtaaagcagtggctggtttttcctgagcccagccctgggaggtcgtggtaggtgtggaggctgcagagctcctccagatgctgccctcgctgtgcc

SEQ ID NO: 929 - DNA, 209 bp, Homo sapiens
ttttttcaccatctaacaaaggcactttattgcattaccattcacaattaacagtcaagaacaaataataataacaaataaaataacttttaagaggacaaggcattagaaataaaaaaggacactaataacatttgtaaaagcttgtactggatgtggttgcccccatttgtgtgtgtggttgtgtgtgtgtggttgtgtgttggtgg

SEQ ID NO: 930 - DNA, 617 bp, Homo sapiens
cgcgtcctttaacaagccccgttctcaaaaggctgggggtatttatataagaacttattccaaagtgactctaagatccatgttcccaagatctagtacgggctattcatggttctgaggcatgtccagcatgcaggcaaacttatctgttcaaattgaggtaaaacagacaaaaaacacttaatattaacagaagctacataattaaaactaaccttctgctgcttatttaagctaatgatgtattcttaccaaacagagaccctcaagtcaatcatttcttttgattttagttaccacccccaaattaagcctcttctttcaaagccattattagttaaaaaaaagttttaaaatgaagaaaaatattttttccagaacttgtattttgtaattagtgtgatgcaatttctttttatttttcaaacttagaaataactcatgtatggtactatttggtatttttttcagataccaaggaataccgacaggattcataaataggattttctgacactggcaggaaagtctgctaacgtttacaaaataccaaagactcttctttcaagcttcaaagatggctgagaattaacagttatgattagtttttcagtaca

SEQ ID NO: 931 - DNA, 521 bp, Homo sapiens
ccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttt

SEQ ID NO: 932 - DNA, 197 bp, Homo sapiens
ccttgtgaccaattacatatgattaaaattacttcccacattcacatccacagtactcgtccaccatttaacatctcaaccaaaacgttacacatgtgaaacaatcactaacaggcaaaaatactaaacctgtatatttggtattgcaaatacacttatgcatgagcaagcaagggattcacagtgagaatctacag

SEQ ID NO: 933 - DNA, 610 bp, Homo sapiens
cctcattttaacaatatcttttttttgctcttctgcttccaaaccttatttgccaatgtaatgcctttatataaagttcttatgatgaatgaaaaactttcaagtgctgttgcctcattaaatgcattatttattaatttaacttctagtactctcgataaagagccagtgaaatgagttattgagttccagggaaaaaaatgagaacataattttgaatttattatctctctatacacacacagttcataattggattacatataataataatatcaacaagtctatcagtatcgaagttggatactggtaatttctcatgtgaggctcttgtgtcacagtcagcatagatttctggagcatttgtctgttgatcttttggtggcctcaaacctcattaagtggtgtgggagatgctgtttctgccatgtgagaatgtgatggcagaattaacacaaccccaccaggggtacaacagagcactttacatccaaaggcagagagggacacagcaatgcagaattccagcacacttaagaggagcaccatgccatccagacccattaagatggacatagtcccatgacaattatttgagttgccatagtag

SEQ ID NO: 934 - DNA, 384 bp, Homo sapiens
ctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctctgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccaggcag

SEQ ID NO: 935 - DNA, 125 bp, Homo sapiens
  misc_feature 1, 23, 24: n = A,T,C or G
nttaaaattcatggaagtaatannacagtaataaaatatggatactatgaaaactgacacacagaaaaacataaccataaaatattgttccaggatacagatattaattaagagtgacttcgtta

SEQ ID NO: 936 - DNA, 546 bp, Homo sapiens
  misc_feature 519: n = A,T,C or G
gcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcaggttctcccgccaaggttctccccctgcctcgaggaggaaggggctggaggctcatggctctgcctcccatagaccccctggatcaccgggatgctggagatctctggttccccggggagtctgagagcttcgaggatgcccatgtggagcacagcatctccaggagcctcttggaaggagaaatccccttcccacccacttccatccttctcctcctggcctgcatctttctcatcaagattctagcagccagcgccctctgggctgcagcctggcatggacagaagccagggacacatncacccagtgaactggactgtggacctc

SEQ ID NO: 937 - DNA, 550 bp, Homo sapiens
caccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcaccca

SEQ ID NO: 938 - DNA, 192 bp, Homo sapiens
  misc_feature 28, 63, 148, 153: n = A,T,C or G
tttttttttttttttttttttttttttnggaaaaagcccaaaaggcactttattggaggtctntgcctccattcacaggaaaaaggagctgggagccccatcctaagggtcccagcatcagcccactggagggcctggaacagtccancactntgtgggaaaggagtggggaggggaatgttttaaaaaaaa

SEQ ID NO: 939 - DNA, 337 bp, Homo sapiens
ccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcagg

SEQ ID NO: 940 - DNA, 362 bp, Homo sapiens
cctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtggtgtgcaggcccacttcttaccccagatagcctcgggcgctgcctgtagtcatgccgacag

SEQ ID NO: 941 - DNA, 216 bp, Homo sapiens
ctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcatgtcgcccgctgagctgagtgg

SEQ ID NO: 942 - DNA, 324 bp, Homo sapiens
ctgattggcttcaggccccctacctctataaactctaccagcattactacttcctggaaggtcaaattgccatcctatatgtctgtggccttgcctctacagtcctctttggcctagtggcctcctcccttgtggattggctgggtcgcaagaattcttgtgtcctcttctccctgacttactcactatgctacttaaccaaactctctcaagactactttgtgctgctagtggggcgagcacttggtgggctgtccacagccctgctcttctcagccttcgaggccagggagcctcaaatcttcagtctctcagagaccacag

SEQ ID NO: 943 - DNA, 597 bp, Homo sapiens
ctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaaagagcatgatcctgtaggtcaaatggtgaat

SEQ ID NO: 944 - DNA, 359 bp, Homo sapiens
ctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctgg

SEQ ID NO: 945 - DNA, 367 bp, Homo sapiens
caggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgggaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtgg

SEQ ID NO: 946 - DNA, 335 bp, Homo sapiens
ccacagaggtggtattacaaaatatacaaagtggtttctttctttacatttcatagaagaagcctgcctcatttccaaatgagagcactagaagcacaaatcatgcagaccatttactatataacttatgaaaaatgctgtacagggctgtgactatagatatagagtatttggctctgtttgggaattgatatctacaagggggagggtcaggggaggactgtccgatatcctgacttgctgggatggtggagaagctgggatgggggaggccccaatcttgctgcacggctacacccactcctcctttcctagacaaggctggagcgcactgg

SEQ ID NO: 947 - DNA, 384 bp, Homo sapiens; identical to SEQ ID NO: 850

SEQ ID NO: 948 - DNA, 173 bp, Homo sapiens
ctgtggaggggacactgtctttgaggcatcactggttccacaaagggtaggggaaggtcttgagggaccaccccatgccctcattaatcaaccagaagcttggcctggagcagcagcggggattccagtagctgtgggcatacaggatgctagggcggccacaacccaggcag

SEQ ID NO: 949 - DNA, 211 bp, Homo sapiens
  misc_feature 13, 14: n = A,T,C or G
ccatccacgttgnnaaacagaataaaatggaaattcaccttgtcatctacccgacattggccttcctgtgccacggcatcatgggctgcctgtatggcctcattcttttcaaagcattttgctctgtcttcaggggacattttctctgtttcagaaagaaactgtttcagaactgatccatcctcaaatcccagtttgtcttgattattgg

SEQ ID NO: 950 - DNA, 382 bp, Homo sapiens
cctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccag

SEQ ID NO: 951 - DNA, 473 bp, Homo sapiens
  misc_feature 421, 456: n = A,T,C or G
cctctctgccaggcaaaggagggagctgcggctctttgacattaaaccagagcagcagagatacagccttttcctccctctccatgaactctggaaacagtacatcagggacctgtgcagtgggctcaagccagacacgcagccacagatgattcaggccaagctcttaaaggcagatcttcacggggctattatttcagtgacaaaatccaaatgcccctcttatgtgggtattacaggaatccttctacaggaaacaaagcacattttcaaaattatcaccaaagaagaccgcctgaaagttatccccaagctaaactgcgtgttcactgtggaaaccgatggctttatttcctacatttacgggagcaaattccagcttcggtcaagtgaacggtctgcgaagaagttcaaagcgaanggaacgattgacctgtgaattctttgccgtctaangcagttgtttatgacag

SEQ ID NO: 952 - DNA, 312 bp, Homo sapiens
ctgatgggtctcatagtcctctgggatggtgtcattgcagcggtaacgcaggttggcccagatgatgttctcctgggagaagcagaagacccccaagcggccaccccgcatggttgtgtccaagaccacgttgctgtcggccaccagctcagggccctcatagaatcgcaccctgatgtagcccacttggggccggtgctgcaggaaccaacgataggacttcttgtccttccaacccacgtttcgcgggtccttccacagcagccgcacctgagactctgtgtctcctgtatgccacagagcgttccgcag

SEQ ID NO: 953 - DNA, 397 bp, Homo sapiens
cgcgtccactgccgaccctcttggtttctgaaaccaacctttcttcctgctctcctctttaagagcaaaccccaacatgtataaggtcacagcaagtggtagccaggaaaagctgtgggacccctcatttgagtcacatccatatggcatggagaaagaaaacctctctgccagaaggaactgaactctggaagtcctaaggaaggtcaccatgatcagcagataggaaagcattgccaagggctgtccctcaagagcttagttttcttagggagaccagaaagacatcagatcctgactgccctgttttgctcaagttctgaaatgagtggcatgatgaagagctggtggagctgagggaaagagtcaaccatgtggggtggggtagtgaggaagg

SEQ ID NO: 954 - DNA, 304 bp, Homo sapiens
cctttgtaccgggccagcaactggaagggcacagtgtggaattccagggcctgcagagtcttcttctggaacagggcctcgtggctccagtacagggacaggttgaactgcagctcaaagagctcctcagggagcatcatggggaagcggatcttctccaccaagccctccacctcctcatgggaggcacgctccccccagctccaggtgtccacggccttcagtagggccagctcgctgggcaccgccaggtcgctcctgggcagcagcagttggagcaggtctgtggggacactgggccagg

SEQ ID NO: 955 - DNA, 156 bp, Homo sapiens
ctgtttcaactccctgccaagaaaaatgtagatgcaattctggaggagtatgcaaattgcaagaaatcgcagggaaatgttgataataaggaatatgcggtcaatgaagttgtggcaggaataaaagaatatttcaatgtgatgttgggcactcag

SEQ ID NO: 956 - DNA, 543 bp, Homo sapiens
ctttcatctgaccatccatatccaatgttctcatttaaacattacccagcatcattgtttataaccagaaactctggtccttctgtctggtggcacttagagtcttttgtgccataatgcagcagtatggagggaggattttatggagaaatggggatagtcttcatgaccacaaataaataaaggaaaactaagctgcattgtgggttctgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaatt

SEQ ID NO: 957 - DNA, 528 bp, Homo sapiens
ctgtgatcaagatgtattaaaagaatatgaaagagcatctgggttattctagaagttctgtgatcaaaacatattaaaaaaaattaaagcgcatctgggttattctagaagttcctgggctttatacttggatatttacagaggaagttgaacttcaagttctgccactcttcaaaatgggtgacaggagaggacgtgataggacagttaaaaaaaaattgatagtcattctctgatggagtgaagcaagctttgtcaaccatcaacaaatatgacttcattggtcacaagccctgcagagatccaacaagatttgagttttaaatacagaacatatttcaaacagaaccagcagagtgctgatgtatgaatggaattgattgctgaaggcagagagtataaagaatctcaagaaacttttagtgccattttcatttaataagccattggtatagcaacctaaaaaccttggctgtgatgacaccaggatgtgtttatggaattgctgcaggagaacacaattggcag

SEQ ID NO: 958 - DNA, 451 bp, Homo sapiens
ctgtctgaccatggggaccttctgtctgaagaggagctggatgaatgagactctgggaatcatctacacaggaccaaacccaacaggcgccctggcaccggggaggcgggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaagtagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccag

SEQ ID NO: 959 - DNA, 158 bp, Homo sapiens
ccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccag

SEQ ID NO: 960 - DNA, 235 bp, Homo sapiens
ctgagcagggaatccggccggaggaaggagcagcttaccgactgcgggtgttcaccacaggccaggccctaatatgcacccactagtttagctcagactcctctctacatatgaatggcaaaggcacttttgatatacactgtaaaatacactgtattttagaatcggaatctattttctaatgttcccctcaagggctgagtggcaggaaggttgaggatgcaggactttgcag

SEQ ID NO: 961 - DNA, 375 bp, Homo sapiens
cctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccc

SEQ ID NO: 962 - DNA, 409 bp, Homo sapiens
  misc_feature 14, 26, 73, 74, 81, 103: n = A,T,C or G
ctggggaggccccncgggcctctcangtggacaggtccaggcattggttgaagctggatgaagctggggcctnngctcctnctcatcaaatacagatcactgngaccctgtcctcctccatggtgctggtctcctcggccccactgcccctgcttctgctttcttcctccacctcctcctcccccagctccatgtccagctcgttgcctgcctctgagggtgtgtaggtggagccactgatggaacggcagctaaagaagacgattcgcttgagccgcttgttgtagaagaagtagttgaaggaccagaggctaccatcctccccgaagggatctgagtccaagtctgggttatagctgtagatgtcacattcagccaggcagatctcctcgtccaccgcgttccacag

SEQ ID NO: 963 - DNA, 163 bp, Homo sapiens
gccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccag

SEQ ID NO: 964 - DNA, 344 bp, Homo sapiens
ccactggctgagttattggcctggcaggtatagagtccgctgttcttctcagtgatgttggagataaagagctcttgtgtgtgttgctggatgttcccatcaatcagccaagaatactgtgcaggtgggttagaggctgcatggcaggagaggctgaggttcacccctggacggtaataggtgtatgagggggaaatggtggggtcgtctgggccatagaggacattcaggatgactgggtcgctgtggtcaacacttaattcgttctggattccacactcatagggtcctacatcattccttgtgacactgagtagagtgagggtcctgttgtcattggacag

SEQ ID NO: 965 - DNA, 461 bp, Homo sapiens
ctgagctttcagcagataaatcacagcagaaatagaatcaccctaggactttcaatcaaaagctggaagtccaccttacagaaagacaaaaagaaacccctttttatatcttaacaaagcaatagctctcaagcagcagagcatctcgaggaaggaagcttgcccggtcgccatcccatcatgccagagcgtgcagtgtccacccttgactacgctggggaattgctgattttttgaaaaagcttaacttaacaatttctgatgtctatcttttagagttctgtatgttcccattttttattcttctgaattttgaattgcaagtagctgtaaaatccaatctttgagtgcatgggggtgggtgtgaggcggggctcagcttcaaccccctgtcctgtaaagcagtggctggtttttcctgagcccagccctgggaggtcgtggtaggtgtggaggctgca

SEQ ID NO: 966 - DNA, 246 bp, Homo sapiens
cctttcacagacactaccattgagtgggttgatgcaggttgcagccttcagtccccgagtactgggttctgataaaattccacagaatccagcatcactgggctcagacggcatccactgtagtaaactatttgtaaatggggacatatcttcccagcaccagtaggacacattgatcttccgaaggccgacccatggggttaaggtgagcttggacatgctctgagatgactgcattattcgcag

SEQ ID NO: 967 - DNA, 244 bp, Homo sapiens
ctggagcattggcagggacagtcagaaaggagacaagtgaaaacggtcagatggacacaggcggaggagaaaagacagagggagagagaccatcgggaacaatcagaggggccgagacgatcagaaaagggtcagcccgagacaggctgagccagagtttctagaagcagtttccaattcaacggctcgctttgagggccaacgtgtcctaggccgaggctgcagaagcgctcacacactcacg

SEQ ID NO: 968 - DNA, 436 bp, Homo sapiens
ccaaagtctttaccctatttaaccccttgtatatttctgactgctcactgttcatattataggggaccagatttgtaatatagaattctccataacatgaatgaaattaatgctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtacgtgtgtattttaatatagcctgacctgaatttatatgtttttagctttagtatttaactttttgtaacaaataaaccttttttaaaacaagtttaaaaaagaaaaa

SEQ ID NO: 969 - DNA, 383 bp, Homo sapiens
ctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcgaattagccccaaattgaacgctgaatcgtgtcccatgagatcaggcgccatctgtaaagtctcctctggaaatgccaatccatccttcccccag

SEQ ID NO: 970 - DNA, 543 bp, Homo sapiens
ctgtagcttttgtgggacttccactgctcaggcgtcaggctcaggtagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacctaggacggtcagcctggtccctccgccgaacaccgaagtgctactgtttgtatatgagctgcagtaataatcagcctcgtcctcagcctggagcccagagatggtcagggaggccgtgttgccagacttggagccagagaagcgattagaaacccctgagggccgatcagtgacatcataaatcatgagtttgggggctttgcctgggtgctgttggtaccaggagacatagttataaaaaccaacgtcactgctggttccagtgcaggagatggtgatcgactgt

SEQ ID NO: 971 - DNA, 416 bp, Homo sapiens
ccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcaccactgtactccagcctgggcaacagcgagactccatctcaaaaaaaaaggaaatgtgtatcaagaacatgattatccaggggtattttctaattcagatcatcaaactgattatatagaagagttggctttaaaatgtttgca

SEQ ID NO: 972 - DNA, 242 bp, Homo sapiens
ccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcag

SEQ ID NO: 973 - DNA, 347 bp, Homo sapiens
cctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcaggacattttcttcccacagatagaaaaggagggagttacactcaggctgcaagcagtgacagtgcccagggctctgatgtgtctctcacagcttgtaaagtgtgagacag

SEQ ID NO: 974 - DNA, 571 bp, Homo sapiens
gaaagagcgagatgcgagaacacttttggctaaaaatctcccttacaaagtcactcaggatgaattgaaagaagtgtttgaagatgctgcggagatcagattagtcagcaaggatgggaaaagtaaagggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgtaataaaagggaaattgagggcagagcaatcaggctggagttgcaaggacccaggggatcacctaatgccagaagccagccatccaaaactctgtttgtcaaa

SEQ ID NO: 975 - DNA, 221 bp, Homo sapiens
  misc_feature 15: n = A,T,C or G
ctggaggtgcctcanaaggtgcattctgcttcctgcaggggcttgaaacaccaaggcactccagggatcctggagtcaaagcagcagccccggttgttgcactccttgggggtgacatgggggtagccgcagtccaccctgtccttggctggcacggcacactggtttgcagacaggcccacgtactcctcagcagagctggaggacagcaaggccaggac

SEQ ID NO: 976 - DNA, 316 bp, Homo sapiens
ccatcagattgtcacagacttttataaccctttgatccctaccaacgttaagtatgagtttggccctgccatcttcattggctgggcagggtctgccctagtcatcctgggaggtgcactgctctcctgttcctgtcctgggaatgagagcaaggctgggtaccgtgcaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaagg

SEQ ID NO: 977 - DNA, 335 bp, Homo sapiens
cctgtttgtctgtacagcaatgcagatgcgcaggcccatcctggtggaggacccagatgcagggagcaaatattcgggttgtgttgctaagagtcgcaggaactactgctagtgatactaggcttgctgcaggaggatgtcacgctgagaaagggagatgactaggagcagaaaaagtactctcactgttccagcttccagcccaatcctagcagaatgaatgcattttaaaatcagtccacattcacatgtgctgagaaggttgttagtggtccctcatctgggcaaagcagacccaagatggtgctaagtgcagagtgcagagcattcttgtg

SEQ ID NO: 978 - DNA, 280 bp, Homo sapiens
cctaacacccaagctcttccttgcagaagagctgagatgctaaggagaccatctggagtgtcataataagcccttgggatttgctgagctcccacatggctttcttcaaccacctggcccactttcttcaaccacattccactttggaatgcgtgtctttaaggcaccaagtgatcttaagaatgggctctgtttttgaattcagcaatccaagttcctatctatctcggtgggacctccaaaaaaaagaaaaaggattggcttggcttctaatgtaagg

SEQ ID NO: 979 - DNA, 318 bp, Homo sapiens
ctgtccagatgacagtaagattccactgtctgtaatcctcatggtgccaggtctcctggggcatctagggcaatgatgctactgcagtttatgcagttacacagtcaagtctgtgccaaaggaggtcccatccggcggccaggtttctgttcagtctggggagcaatgccaactggctgcccccatagcctggcatgagctgatggcccagtgcaatcccaaagcaaagaagggcagaactgggccaagaagctgtggtaatttgctctccctgcctccgacagcgtcgtcctctccttttgcagccccacacgcagg

SEQ ID NO: 980 - DNA, 568 bp, Homo sapiens
ccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatgggagaaccaggaagatgtggtcattcattcaatagtgtgtgtagtattggtgctgtgtccaaattagaagctaactgaggtagcttgcagcatctcttctagttgaaatggtgaactgataggaaaaca

SEQ ID NO: 981 - DNA, 550 bp, Homo sapiens
ccatccccctttagaacgtatcttaatgtgaacataaattgttcttcatgatgcttaaaagcttacatataattttcattcttagaaaaacgccacattttggatcctggatttttctgaatatcatgattgaaaaaaacaaaacaaaaaatgaacccaaatcaaagtgtggttaaacttatatgagaaagatttttcaaccagatggtcattcaaaaaagttggagctgtaagtgccggcgactgaggacacagggttaattcctcgctgctggtggaaggctagagaacatcttcaaaagagggtagcaagacgtgctcctaggggaggctcagtgtggtctcgtctgcccaagcattttcagtcttgcttggtcaatgacatcgagtaagtttttggcatccacagccagggcgtgagcagcagtcagcatttgctttttgtactcttgctggaggctggtcatgacatactgctgggccagtttcatcttgttgatgagctcacccaggtcagagttcaatagcttctgtgccatctcaatctctc

SEQ ID NO: 982 - DNA, 524 bp, Homo sapiens
ccaaggtcagaggctgatgcaacaggccctcttctccccagggccaggctcctgtccagcctgggcactgcccagagtgatggcattggtccggatgctgttctgtctctgcttggacaccttcgcaaagatttctttcaggacagtctcaaaggctagctcaacattggtagagtccagggctgaggtctccaggaagagcagtccattgttttcagcgaacattcgggcctcctcagtgggcacttcccgggcctggctgaggtcacttttgttacccacgagcatgacgacgatcgtggcttcagcatggtcatagagctccttcagccatcgctccaccacagcataggtctggtgcttggttaggtcaaacaccaggagggcccccactgcaccacgatagtacccttgaagacaaagttataatcttcctcagttccattccccatcttggctccgcatggagggtgcaggtgtcttcggggacagaggcgacaaatctgtgtgttggctcaatgccc

SEQ ID NO: 983 - DNA, 140 bp, Homo sapiens
ccttcgtgccctaacagccagtcccctgttaaagtggaagagacctgtggctgccgctggacctgcccctgtgtgtgcacaggcagctccactcggcacatcgtgacctttgatgggcagaatttcaagctgactggcag

SEQ ID NO: 984 - DNA, 358 bp, Homo sapiens
tggagcggccgcccggcaggtccaacgagtcacaacagtgcaataggtagaggattaaaaactgcatcaaacaggtgctgaaaataaatactacctaggagaaggaggtgagagccctcgtgtggggtttgttttcgaccccttgagtgtgtgtggggtttgtcttccgagccacgagcctggcctgtctcgcggtgctgttcactctgacagagtgcgcctgcagcacgttgcctccagggcccagcctcccagaagcctcagagcatcagagcatccgtcccatcggatggaccagaaacaagaaaatggggtggggtgaatcacagctatcattcaaaggaaaggaatttttttc

SEQ ID NO: 985 - DNA, 450 bp, Homo sapiens; identical to SEQ ID NO: 830

SEQ ID NO: 986 - DNA, 340 bp, Homo sapiens
cctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatatccagttttatttatttatttttaatttgtttttttctccaagtccaccagtctctgaaattagaacagtaggcggtatgagataatcagg

SEQ ID NO: 987 - DNA, 227 bp, Homo sapiens
ccaatgcccggagcaggccctctttccatcccgtgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatgg

SEQ ID NO: 988 - DNA, 241 bp, Homo sapiens
cctctttttaccagctccgaggtgattttcatattgaattgcaaattcgaagaagcagcttcaaacctgccggggcttctcccgccttttttcccggcggcgggagaagtagattgaagccagttgattagggtgcttagctgttaactaagtgtttgtgggtttaagtcccattggtctagtaagggcttagcttaattaaagtggctgatttgcgttcagttgatgcagagtgggtttt

SEQ ID NO: 989 - DNA, 193 bp, Homo sapiens
ccagccgtgtcccagacttgtagtttgatcttcttcccctctatatccacagtgcggatcttgaaatcaattccgatggtggagatgtaagtgttgttgaagttgtcctctgcaaagcgaatgatcagacaagtcttgcccacccccgagtccccgatcagcagcaacttgaagaggtggtcgtaggctttgg

SEQ ID NO: 990 - DNA, 499 bp, Homo sapiens
cctcaaccaagagggttgatggcctccagtcaagaaactgtggctcatgccagcagagctctctcctcctccagcaggcgccatgcaagggcaggctaaaagacctccagtgcatcaacatccatctagcagagagaaaaggggcactgaagcagctatgtctgccaggggctaggggctcccttgcagacagcaatgctacaataaaggacacagaaatgggggaggtgggggagccctatttttataacaaagtcaaacagatctgtgcgttcattcccccagacacacaagtagaaaaaaaccaatgctgtggtttctgccaagatggaatattcctcctcctagttccacacatggcgtttgcaatgctcgacagcattgcactgggctgctgtctctgtgttctggcaccagtagcttgggccccatatacacttctcagttcccaacaagggcttatgggccgaggggcaggctccaattttcaagcacacga

SEQ ID NO: 991 - DNA, 262 bp, Homo sapiens
ctgccagccaggctgtggtcagtcctctggcaggcaatcttcggcaccgagagcctctgtccattagtgtcagccccgagggggccacgacggaggccgcccaatgtccactgtgatattggtgaagagtggttgccgagacacctccaagacctggtaccgcactgacccaatgccgtcccgcttcatggtcagcttcgtgttttgaatcttggtaaacctctgagggttaggttcgttatgcttgtcgcggtcgtgcttg

SEQ ID NO: 992 - DNA, 535 bp, Homo sapiens
  misc_feature 90, 91, 467, 524: n = A,T,C or G
ctgctgcttgtgaaattcatgtgtggtactaagtaccttacatgaattatttcatttaaccctcccaacagtctcctttgtacgtgctgnnctctctgcctggaaacactgtttcccacccccaacccccaattcttctgtttatttttcttgagacagagtctcactgtgtagcccagactggagtgcagtggcgcgatctcggctcactccaatctccgcctcccgggtccctgttcaagcagttctcctgcctcagcctcctgagtagctgggattacaggcacacgccaccatgtccagctaatttctgtatttttagtagagatggggtttcacgatgttggctaggatggtctcgatctctggtcagagtcttttctgtaaatatccttggtaaagaagcaattttagactgtagctgttgcaaatgctttaaggaagaagcaaaacaactgtcagtcttnctgaaatgaagaaactacaccagggctgctatatcagagcaaccccaaccagcactncaatcatgatg

SEQ ID NO: 993 - DNA, 232 bp, Homo sapiens
ctgctgctctcccctcccagtctctactcactgggatgaggttaggtcatgaggacaccaaaaacctaaaaataaacaaaaagccaaacaagccttagcttttcttaaaggctgaaatgcctggaagtgtccctttatttataaaataacttttgtcatatttcttatacatgtttcttgtaagaaattcagaaactacagacaaagagagtggaaattacccactgtcagg

SEQ ID NO: 994 - DNA, 203 bp, Homo sapiens
ccagcagatcatccacgacgaccaccctctgtcctggctccagggcgtctttctgaatctccagctcagccttcccgtactccagggaataggaggcccacagagtggggcctggcagcttcccccgctttcggatgagcacgcagcccagtccaagctcctgggccagggaggggccaaagaggaagcctcgggagtctagg

SEQ ID NO: 995 - DNA, 238 bp, Homo sapiens
ccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtcccaaactcctgagatcaagcaatccgcccacctcagcctcccaaagtgctgagatcacaggcgtgagccaccaccagg

SEQ ID NO: 996 - DNA, 379 bp, Homo sapiens
ctgcagcctgggactgaccgggaggctctgaccatttacccaccacaggtaggttgtgttctgaacctcaggttcacaggtgaaggccacagcatccttgtcctccacggggttggagttgttgctggagatggagggcttgggcagctccgggtatacatggaactgtccggttgcttcttcattcacaagatctgactttatgacttgtagggtatagaatcctgtgtcattctgggtgacgttctggatcagcagggatgcattggggtatattgtctctcgaccactgtatgcgggccctggggtagcttgttgagttcctattacatatcctacaattagactgttgccatccactctttcgcctttgtaccag

SEQ ID NO: 997 - DNA, 210 bp, Homo sapiens
ccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaaggccgtggagaagtgtaaagatgcaggattgg

SEQ ID NO: 998 - DNA, 207 bp, Homo sapiens
  misc_feature 61: n = A,T,C or G
ggtggctgtgctgggggcgccccacaaccctgctcccccgacgtccaccgtgatccacatncgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggccca

SEQ ID NO: 999 - DNA, 315 bp, Homo sapiens
ccaatgggctttgctgtagcttgctgaaatcaccaagcaggagagatttaaccagaggcgatgtgtccagtcaccagcatagagccatcctctgtgtcaccatccacacgcagggccttctggcagacctcatgcaatgccctccatgttaatattcatcagaaaatggataattaggggggccagcaaaaatatcaagggtcaaatatcgcacatttctgtttaggccatctatggctttcatctcctctgaagtcaactggaattcaaacacctgcacgttctgtctgatgcgctgctcattgtagctcttgg

SEQ ID NO: 1000 - DNA, 186 bp, Homo sapiens
ctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcag

SEQ ID NO: 1001 - DNA, 173 bp, Homo sapiens
ccacaaagcggaaactcatccacttttgcctttttccgccccaggtcaaaaatgcgaatcttggcatcagggacacctcggcagaagcgagactttgggtacggcttgttcttacaataccggtaacaacgggcggggcggcggcccatggcgacaccaggatcttcagtggc

SEQ ID NO: 1002 - DNA, 302 bp, Homo sapiens
ctgaatgcctgagcccagcagggagctgaggatcatggggtactgggggggcctgaagacgtcgccgtgcaccaacttccacccagactcctccatggtgtcttcaatgtcatcctccttgttgtagttggcaatgtccttccggagggtccgaatgataatcatgctcaggatacctgacaggaagaagaccacaacaacggagttaatgatagaaaaccagtggatctggacgtcactcatggtcaggtaagtgtcccagcgagaggcccatttgatatcactttcctcccagtggacag

SEQ ID NO: 1003 - DNA, 368 bp, Homo sapiens
cctgggcccgctgacttcagggtgaggccacagctactgcagcgctttttatttatttatttatttactgagatggagtcttgctctgtcacccaggctggagtgcagtggtgcaatctcggctcactgcaacctctgcctcctgggctgcagtgattctcctgcgttcaagtaattctcctgcctcggccttctgagtagttgggattacaggcatatgccaccacacttggctaattttttgtatttttagtagaaatggggtttcaccatgttggcgaggctggtctcgaactcccgacctcaaggatcctcctgcctcggcctcctaaggtgctgggattgcaggtgtgagccaccacgtctgg

SEQ ID NO: 1004 - DNA, 294 bp, Homo sapiens
ctgggcggatagcaccgggcatattttggaatggatgaggtctggcaccctgagcagtccagcgaggacttggtcttagttgagcaatttggctaggaggatagtatgcagcacggttctgagtctgtgggatagctgccatgaagtaacctgaaggaggtgctggctggtaggggttgattacagggttgggcacagctcgtacacttgccattctctgcatatactggttagtgaggtgagcctggcgctcttctttgcgctgagctaaagctacatacaatggctttgtgg

SEQ ID NO: 1005 - DNA, 414 bp, Homo sapiens
ctgaagcactcttcagagactacgtccacagacactgatgctgaggcctttcttgtaagtgaagaaaaaggaatgcagcaaagaagagttcgacattggagtccttagttccatcaggatcccattcgcagcctttagcatcatgtagaagcaaactgcacctatggctgagataggtgcaatgacctacaagattttgtgttttctagctgtccaggaaaagccatcttcagtcttgctgacagtcaaagagcaagtgaaaccatttccagcctaaactacataaaagcagccgaaccaatgattaaagacctctaaggctccataatcatcattaaatatgcccaaactcattgtgactttttattttatatacaggattaaaatcaacattaaatcatcttatttacatgg

SEQ ID NO: 1006 - DNA, 272 bp, Homo sapiens
ccggagcccacggtggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccag

SEQ ID NO: 1007 - DNA, 313 bp, Homo sapiens
  misc_feature 14: n = A,T,C or G
cctgccttactctnttccctttccccagggactcttggttttcagaagcccctctggaatgtcctacctggcctaaccccataccagcagtgcagacaaggaggcactcctactatagtgggtccagcccatggagagactcacttcctgccccaacacctcttcccctagaccctgagggccaggacaatgtcttagtgccttccaacttggcagagtgaggccccatgagacagagagaaagggggaagagggaaatacctttatccaaataaatacccatccaaaattatttgtgataggtgaaaaatgg

SEQ ID NO: 1008 - DNA, 317 bp, Homo sapiens
cctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctaccaagcgacccactgattattttgcggaaatgg

SEQ ID NO: 1009 - DNA, 456 bp, Homo sapiens
tttttttgtagggtatagaaaatacatttttaattttgatagagttcacaaatgacagcattgacatttctttaaacaaatacttctgtcaaggcacagcattaccatgtgtccccagatgcccaagaggcagtgatttcatgtccccctgaggtttagcagagccaccaatgtcaatagggtggctgacggggcctagatttgctaccagataagccaatgagacatgctgtcagatttatggttacataatcaagtatttaaaaagatgcacaataggtaactgcaatgagcttgttctgcatttagcgatagttcctttcaaacaaagaagatagttttcagtatcaagaaggatgcctatatgtatgtcttccatggagcctttcctacaaattgctttcattacacattaaaaggagttcagctttattgtgaccttcttgagtcattcag

SEQ ID NO: 1010 - DNA, 196 bp, Homo sapiens
ctgggcatgggctgaggagaggtcttgcttgcccccttcaactttccatctcagaactataaactgctaggctgcaaggagagaagggctaagtgggggtcagacaggagagaagggcaggaggcagtgagccccgatgacccaccaactccaccaggccctgacagggaagcccctttggttagtatcattttgg

SEQ ID NO: 1011 - DNA, 449 bp, Homo sapiens
ccttgcggctgctgcgaaaggccacggcgctgcctgcccgccgggccgagtactttgatggttcagagcccgtgcagaaccgcgtgtacaagtcactgaaggtctggtccatgctcgccgacctgaaggagagcctcggcaccttccagtccaccaaggccgtgtacgaccgcatcctggacctgcgtatcgcaacaccccagatcgtcatcaactatgccatgttcctggaggagcacaagtacttcgaggagagcttcaaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagaccttgtacctgctgtatgcacag

SEQ ID NO: 1012 - DNA, 289 bp, Homo sapiens
  misc_feature 274, 275: n = A,T,C or G
ccaggaccacaaccccacgctgtagctggtagcgcagggcaatcagggctggggttcgcttgtgcttttttgccaaggcacaaaggactgggtcctccaagagcaccggggagttcgggtccacccatggttcttctcggtgggatcccagagcactataggcaaccagaacaatgtcttttgacttgcagaaatccagcagttttctctggttgaagtaaggatgacattccacctggttgcagacaggcttgtacttgagccctggcttgtnnaggatcatctccag

SEQ ID NO: 1013 - DNA, 221 bp, Homo sapiens
  misc_feature 98, 99, 132, 133, 180: n = A,T,C or G
tctgtaaatgctgcgttcctaatttagtaaaataaaagaatagacactaaaatcatgttgatctataattacacctatgggatcaataagcatgtcannactgattaatgtctactgtaaaaatttggtagnnaaattttcatttgatattagatataaatatctgaatataaataattntaatatactagtcatgatgtgtgttgtattttaaaaattat

SEQ ID NO: 1014 - DNA, 512 bp, Homo sapiens
gggcccccgaagcctctacaatgggctggttgccggcctgcagcgccaaatgagctttgcctctgtccgcatcggcctgtatgattctgtcaaacagttctacaccaagggctctgagcatgccagcattgggagccgcctcctagcaggcagcaccacaggtgccctggctgtggctgtggcccagcccacggatgtggtaaaggtccgattccaagctcaggcccgggctggaggtggtcggagataccaaagcaccgtcaatgcctacaagaccattgcccgagaggaagggttccggggcctctggaaagggacctctcccaatgttgctcgtaatgccattgtcaactgtgctgagccggcgacctatgacctcatcaaggatgccctcctgaaagccaacctcatgacagatgacctcccttgccacttcacttctgcctttggggcaggcttctgcaccactgtcatcgcctcccctgtagacgtggtcaagacgagatacatga

SEQ ID NO: 1015 - DNA, 553 bp, Homo sapiens
  misc_feature 518: n = A,T,C or G
ctgggcaggaagattatgatcgcccgaggcccctctcctacccagataccgatgttatactgatgtgtttttccatcgacagccctgatagttcagaaaacatcccagaaaagtggaccccagaagtcaagcatttctgtcccgacgtgcccatcatcctggttgggaataagaaggatcttcggaatgatgagcacacaaggcgggagctagccaagatgaagcaggagccggtgaaacctgaagaaggcagagatatggcaaacaggattggcgcctttgggtacatggagtgctcagcaaagaccagagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcangaagtcatcttgctaccagtatttagaagccaact

SEQ ID NO: 1016 - DNA, 431 bp, Homo sapiens
ccacttcacatgatggcgggcctttaagagcacaaagaagtttaatatggacaacaacaggaaaaagcaagaagaaaacaagtagggaaagacagctaacctggagagagagaatttctttaacctttatgttcttcattaaaaatcttatcttggactgatttgagggatttttagaaacatggccttattttatataagcattaccttcccaggaatctttgttgtatattaatttttgataaccatttgattaactttaaaattaagtatatgtgtgtatatatacatatgtatgtttatatacacacatgtatctgtatagttttatatatacatatatacacatagacatacagagaaccactactttgtaatagtgtacagtttgttttatatctctttactttttttgttactattttatctgt

SEQ ID NO: 1017 - DNA, 490 bp, Homo sapiens
  misc_feature 427, 434: n = A,T,C or G
ctggaagaacaaggcgaagttctggtggctgtctgcgatgaatgtgcccttggctttggctgggtatgtcacccgggtagttttgggtgcaatgctctgatccttatccacggtggaaagatcaacatttgtgatgccaacttcagtggagatcttgactctgagctctacggtatttgcaatataccggttgtcaccttcaacttcgacaaggaagtcataataaccactggaaaatttgacgttcatgaaatttagttcaaaaacatcccctacaggggtgaaggatgtcttctggaggacagtggctctggaagcaacagatttagcatgttctagtttaacagtggcctgagtcagaggctgagacagaacattggtgacttgcaaccgcaagatagcctgttcatgagtgtcggaagcaganccctcangcacaaccacaactggcacgtggtagcgattatgcgagagcacaggcagacctcgg

SEQ ID NO: 1018 - DNA, 503 bp, Homo sapiens
ggagtaagctgagtacaagtaccatagcagcagagctgcaaaaggtcttgggacctatagtcctaatgcaagataaggtcatggggcctaaggccatggggcctgaggcacccctagaccctgagccttcagcatttaagggagggtgtccccccattctcgataggccatggtacacagatgggtctagccgaggtgctataactgcttggaccactgttgcagtccaacctagtactgacactatatggtttgaaacccggtgtggacaaagtagccaatgggctgaacttagagcagtgtggatggtgatcaccaaggaggtgacactgatggtaatctgtatcaatagctgggtggtctaccaaggcttaactttgtggttaactacctggaaaatacagaagttgctagtcggccaccaacccatttggggtcaagccacgtggcaagacctctgggaaatgggtcatcagaaacaggtaaccgtttatcatgtgtca

SEQ ID NO: 1019 - DNA, 348 bp, Homo sapiens
cctgtgtatggagtagaggcgggtgcacgggtactgttcctcacggcagtcaagaggcccaggctctgtgggctccagctctgcatttcccggttctggggttggggctgggatgacttcctgttggacttgctgctgggactggaactggaactgttcctcggagggccgaggagtcacctcttgataatcatagtagtctgggttgtcgatctggtcgctatagtgggtgtactggacgtggtcagggaacggcggcagcgggtccaggtcatactggccctgagccagcaagcctgcaggcaggaatagcaggaagaggtaggcagctctcatggcaacaaagag

SEQ ID NO: 1020 - DNA, 260 bp, Homo sapiens
ccacacggcgaccgagggacagatggggccctgcgtcccataggctgcctgaaggtgggtagggcggcctgcggcatagtggggtggctgtgggctcccagcctggcccctgggaaccgtgggagcacagggacaagcacatggctatggaatgcagggtgacccaaggacaagcgagttgcggggatctctactgtgaccatgcagaattgatcgcagtctgctgcgccaccaccacctcatgttcccgaggggaacag

SEQ ID NO: 1021 - DNA, 407 bp, Homo sapiens
ccttatgactataacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttgg

SEQ ID NO: 1022 - DNA, 140 bp, Homo sapiens
ccaccccagagtgggagaggctgggaggttgggaggctgtggagagaagtgagcaaggtgctcttgaacctgtgctcattttgcaattttatcagtaatttgacttagagtttttacgaaacctcttttgttgtccttgc

SEQ ID NO: 1023 - DNA, 280 bp, Homo sapiens
ctggaggtgcctcagaaggtgcattctgcttcctgcaggggcttgaaacaccaaggcactccagggatcctggagtcaaagcagcagccccggttgttgcactccttgggggtgacatgggggtagccgcagtccaccctgtccttggctggcacggcacactggtttgcagacaggcccgcgtactcctcagcagagctggaggacagcaaggccaggaccagccccagcatgcagagcgctctggcagccatgaccaccgtgggctccgggacgcagc

SEQ ID NO: 1024 - DNA, 274 bp, Homo sapiens
  misc_feature 262: n = A,T,C or G
cctggctgagcaggcagagcaccctgggaccccagggcagaaggacccctgccctccagtccccaagacccaggcccgtctccactcatacacgccacctacatgtgacgtcagccctgaaaaggtaacaggaaagttcagaacaaaaacaaaaccccaaaagtaaaaaggctacgtgtagcagagtaataccggaaacgttatatacacaggcggtgatggccccctcggaagtgtccgggtcacttagggggcactgcanaggtccctgtgg

SEQ ID NO: 1025 - DNA, 446 bp, Homo sapiens
  misc_feature 427, 431, 440: n = A,T,C or G
gcaaagagtgtactgtgcttgaggcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatcaaaaaanaaanaaaaaaaanaaaaaa

SEQ ID NO: 1026 - DNA, 189 bp, Homo sapiens
ctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcag

SEQ ID NO: 1027 - DNA, 92 bp, Homo sapiens
ccagaccctccttagtacaggatctcggaccacaaaccaaggagtctcgtggccttggattcccagaccctaggatggtatccctctgacag

SEQ ID NO: 1028 - DNA, 438 bp, Homo sapiens
ctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcag

SEQ ID NO: 1029 - DNA, 330 bp, Homo sapiens
ccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaatcgcaacgtagctgtcatcaacgtgggggcacccgcggctgggatgaacgcggccgtacgctcag

SEQ ID NO: 1030 - DNA, 228 bp, Homo sapiens; identical to SEQ ID NO: 903

SEQ ID NO: 1031 - DNA, 294 bp, Homo sapiens
ccacaaagccattgtatgtagctttagctcagcgcaaagaagagcgccaggctcacctcactaaccagtatatgcagagaatggcaagtgtacgagctgtgcccaaccctgtaatcaacccctaccagccagcacctccttcaggttacttcatggcagctatcccacagactcagaaccgtgctgcatactatcctcctagccaaattgctcaactaagaccaagtccccgctggactgctcagggtgccagacctcatccattccaaaatatgcccggtgctatccgcccag

SEQ ID NO: 1032 - DNA, 278 bp, Homo sapiens
ggaggtattacagacagcactgcactttggagttgggcagctacatcgaggacctctttgtggtccacagtgacctctccagcattgtgatcctggataactccccaggggcttacaggagccatccagacaatgccatccccatcaaatcctggttcagtgaccccagcgacacagcccttctcaacctgctcccaatgctgggtgccctcaggttcaccgctgatgttcgttccgtgctgagccgaaaccttcaccaacatcggctctggtgacgg

SEQ ID NO: 1033 - DNA, 155 bp, Homo sapiens
  misc_feature 9, 17, 31, 74, 75: n = A,T,C or G
cgcgttcanccatgttnaaaccgattgcatnaacttcgaaaccggcccgcccgccggcgcctggagaggggcanngggagaagcagagagtttatcattcatctgtacacatagacgtttcttctttaaataacaccacgggcgggagccccatc

SEQ ID NO: 1034 - DNA, 401 bp, Homo sapiens
ctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaagg

SEQ ID NO: 1035 - DNA, 333 bp, Homo sapiens
ctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtgg

SEQ ID NO: 1036 - DNA, 198 bp, Homo sapiens
ccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaagg

SEQ ID NO: 1037 - DNA, 289 bp, Homo sapiens
ctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctgg

SEQ ID NO: 1038 - DNA, 368 bp, Homo sapiens
ccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccagg

SEQ ID NO: 1039 - DNA, 417 bp, Homo sapiens
  misc_feature 226, 227, 246, 259, 390, 391: n = A,T,C or G
ctgggcctatgctggtcatgaacggtcctggaaaatgactcccttccttcagtatctgcatcctcatgaagtcattcattttggagatcgtgtcttcacttttcttggtgaagaaactgctggatggagttgttggtggcatctgaggagtccgaagatggctctcagggaaggttgtgctggcctctgaaggatttggaagctgactctgttcctggggtagctnnatgctcttggggtcattgnttctcgggtttgnttttttctttatctggataaaactatgcatttctgaaatcagttttgacatctggttcttttttcctaagtcgaaagcagaaaagttggaagcttatctccttcttcacagggggatattgtggacattgnnctgtccccactacatccatttttcct

SEQ ID NO: 1040 - DNA, 409 bp, Homo sapiens
ctgtccaatggcaacaggaccctcactccattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcag

SEQ ID NO: 1041 - DNA, 492 bp, Homo sapiens
  misc_feature 473: n = A,T,C or G
cctcggctccacacctccgctgtgaccacagcctcaggtcaagctgtgctggggccatccaccttcctttgccatttagaagatggggcttggagcttggcaacacagaaattgacatcagccttataaaaccttggctgaacctaccgacctccaggagaatttcagccaaaacaaaaaagcaaatacacagagggaccctggaaccagaatccctccccatgggaaagacgaaggcacagagattcgagccaagtttcccaacatgttggtgtttgcagaaaagtccggtcacgtcacacacagcacagaggcaagaagcgaaggcagtggcattcacaggactactttatattaaagtttattacatttggaaaatctactgtacagggaaaaacccattggattaagtagagttttgccaaaagcaaaagactatcactctttggaaaatattcctgattccagcccanggcccagggtggggccaca

SEQ ID NO: 1042 - DNA, 125 bp, Homo sapiens
cctggctctgatccagtgacccctctcaccaaagaactcggtttaaccagggctctgtaagaccactcccacccagagacttgtgtggcctggtgtggcctgtgtgtcggattccttcctgtcag

SEQ ID NO: 1043 - DNA, 459 bp, Homo sapiens
ccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaagggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctgg

SEQ ID NO: 1044 - DNA, 368 bp, Homo sapiens
cctgggcccgctgacttcagggtgaggccacagctactgcagcgctttttatttatttatttatttactgagatggagtcttgctctgtcacccaggctggagtgcagtggtgcaatctcggctcactgcaacctctgcctcctgggctgcagtgattctcctgcgttcaagtaattctcctgcctcggccttctgagtagttgggattacaggcatatgccaccacacttggctaattttttgtatttttagtagaaatggggtttcaccatgttggcgaggctggtctcgaactcctgacctcaaggatcctcctgcctcggcctcctaaggtgctgggattgcaggtgtgagccaccacgtctgg

SEQ ID NO: 1045 - DNA, 315 bp, Homo sapiens
ccaatgggctttgctgtagcttgctgaaatcaccaagcaggagagatttaaccagaggcgatgtgtccagtcaccagcatagagccatcctctgtgtcaccatccacacgcagggcctcctggcagacctcatgcaatgccctccatgttaatattcatcagaaaatggataattaggggggccagcaaaaatatcaagggtcaaatatcgcacatttctgtttaggccatctatggctttcatctcctctgaagtcaactggaattcaaacacctgcacgttctgtctgatgcgctgctcattgtagctcttgg

SEQ ID NO: 1046 - DNA, 317 bp, Homo sapiens
cctcgcctggagggccccgggcagcacagggaggacgagcttgtccagcagagggtctggcagagggtcccgcagaggtttgggcagggggtctgacatccctggctcctgctctggctctggctgccgggatttgcacaggcccaggtgcatacagatgccgtttgagtcaatctggttctggaagtagtcgatgaccagggggaagtagtcgtcaagcacttggttgcactggggcatgagcagcttcaaggggaggacgttgcactcctgctccaggaacttcctcaccgtgtcctggaaaatggcctccttgg

SEQ ID NO: 1047 - DNA, 412 bp, Homo sapiens
  misc_feature 183, 271, 287, 292, 294, 343: n = A,T,C or G
gtacaagctttttttttttttttttttttttttgtttaatgcttgaactttattttggagagagaaatttagaaagacacaaggtacacagagtaaaatgtttttcttttttcaggaccttgaactgaatcttgcactgctttggtttctatctaggaagctcagcgacagcagagtctgtanaggcggccactgatttcacacaccccggagagggactcacgggtagcacaacggccggttcggcaatagcaggtggctcttgcctganaacctgaggttctaanagcananagtccatttcctgcaaaggagatagcaaggtcctggttgtcttccccanactgcttctgggttgtagcctcatcagctctttcctggagtgactcagcctgggcctgcagggccacca

SEQ ID NO: 1048 - DNA, 476 bp, Homo sapiens
  misc_feature 267, 336, 344, 360, 395, 419, 420, 430, 441: n = A,T,C or G
taaaaaaaggaaaaagttttattacgaaactagtttgtataaaacagggttatacatatttttgtaagtttgtaataaaacagtaagaaaaaaaggcagtaatagaaatctccaaaaggcaacctatcaaaaccaactggctgccactttgagtttggacagtagctgcataaactttgttcttcttgaacagtatttaataacatcattaatacattaacaacatttctataaagtaagacacattggtgctgaagtacaactggnggcctcttgatctcacctatgaggagagttctttacaaaaccacatagggaaaattgcagttgtaaggngaactacncatctaaaatatgcanaggtaatagcattacatgttaaaggtatcaagggnatatacacattttaaaccatttgnnacaaaacttntataaaatttntttctctctctttctctcttatgcacaaaaaatat

SEQ ID NO: 1049 - DNA, 274 bp, Homo sapiens
cctggctgagcaggcagagcaccctgggaccccagggcagaaggacccctgccctccagtccccaagacccaggcccgtctccactcatacacgccacctacatgtgacgtcagccctgaaaaggtaacaggaaagttcagaacaaaaacaaaaccccaaaagtaaaaaggctacgtgtagcagagtaataccggaaacgttatatacacaggcggtgatggccccctcggaagtgtccgggtcacttagggggcactgcagaggtccctgtgg

SEQ ID NO: 1050 - DNA, 472 bp, Homo sapiens
ctgcagcctgggactgaccgggaggctctgattatttacccaccacaggtaggttgtgttctgaatctcaggttcacaggttaaggctacagcatcctcatcctccacggggttggagttgttgctggtgatgaagggtttgggtggctctgcatagactgtgatcgtcgtgactgtggtcctattgaggccagtgtctgagttatgggcttggcacgtataggatccactattattcacagtgatgttggggataaagagctcttgggtggattgctggaaagtcccattgacaaaccaagagtactgtgcaggtgggttagaggctgcgtggcaggagaggttcagattttcccctgatctgtaagatgtgtttagaggggaaatggtgggggcatccgggccatagaggacattcaggatgactgaatcactgcgcctggcactcactgggttctgggtttcacatttg

SEQ ID NO: 1051 - DNA, 249 bp, Homo sapiens
ccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagacctgc

SEQ ID NO: 1052 - DNA, 289 bp, Homo sapiens
ccaggaccacaaccccacgctgtagctggtagcgcagggcaatcagggctggggttcgcttgtgcttttttgccaaggcacaaaggactgggtcctccaagagcaccggggagttcgggtccacccatcgtttgtctcgttgagatcccagagcactataggcaaccagaacaatatctttcgacttgcagaaatctagcaatttactccggttgaaatacggatgacattctacctggttgcagacaggcttgtacttgagtcctggcttgttgaggatcatctccag

SEQ ID NO: 1053 - DNA, 199 bp, Homo sapiens
ccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaaccgtaagaaagggcccagccg

SEQ ID NO: 1054 - DNA, 224 bp, Homo sapiens
tcgaccctgtgaagcaggagacagatgctgcattttcactgttgtttgtcctctgtttttgtagcatccccgggaacttccccatcagccaggggcttgtccccaccacccttcacctggctttccagttggctgagacgctgcttcatcttcatctgggtggcgttgtactcagccaggaggcgtgcaaacctggtctgcagggcgtccagggaggaccccag

SEQ ID NO: 1055 - DNA, 390 bp, Homo sapiens
cctcttattagggctctggtagcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttgccaacgccatcaccgacctcatcagtgagctgtccctgctggaggagcgctttcgggtgg

SEQ ID NO: 1056 - DNA, 450 bp, Homo sapiens
  misc_feature 21, 22, 230, 232, 377, 391: n = A,T,C or G
ccagcatcaccttttggtccnnacactccagggctgccaggagcaccagtgttacccgcaggacctgggggcccatccttgcctggagaaccgctgggacctgggggtcctgggttaccattactaccaggaggaccaggaagaccacgagcaccagggaagccagcagcaccaggtccaccaggactgccacgttcacctttgacaccttggggaccaggaggaccagnangtccagaacctccagggggtcctgcaactccaggagggcctccttcacctttctcacccggagcccctctttctcctttaccaccaggttcaccattctgtccaggagcaccagggaaaccagcaggtcctggagggccagtttnacctctctcaccanggctaccacgaggtccagctatacctggaagtccgggggcaccaccttcacccttacct

SEQ ID NO: 1057 - DNA, 337 bp, Homo sapiens
tgagcggccgcccggcaggtcctcgcctggagggccccgggcagcacagggaggacgagcttgtccagcagagggtctggcagagggtcccgcagaggtttgggcagggggtctgacatccctggctcctgctctggctctggctgccgggatttgcacaggcccaggtgcatacagatgccgtttgagtcaatctggttctggaagtagtcgatgaccagggggaagtagtcgtcaagcacttggttgcactggggcatgagcagcttcaaggggaggacgttgcactcctgctccaggaacttcctcatcgtgtcctggaaaatggcctccttgg

SEQ ID NO: 1058 - DNA, 237 bp, Homo sapiens
ctggggactgggaatgctagcatatggtatctcaagttggctctcagaactaaacggggataagggcctagaatggaagagggaaccagccagaccctcagtccttcctgtcctggactgggagccacagatgtccctgtgatctgtcactgccctgatctgggtcttcagccattaaagctcagtgtcatcttcagtcaccaacgggggtcttggtgtccttccaaacccctttgg

SEQ ID NO: 1059 - DNA, 210 bp, Homo sapiens
  misc_feature 169, 170: n = A,T,C or G
agcccatccccccggctccctcctagtctgccctgcgtcctctgtccccgggtttcagagacaacttcccaaagcacaaagcagtttttccccctaggggtgggaggaagcaaaagactctgtacctactttgtatgtgtataataatttgagatgtttttaattattnngattgctggaataaagcatgtggaaatgacccaaaaaaaa

SEQ ID NO: 1060 - DNA, 564 bp, Homo sapiens
ctggccacagagcccagcaagtccttcctgggagagaagagttagggctgatactgaaggtctctttcacatctgggcacacgtctgccttcaggctgtaagaatttcatttgtcgattgttaaataaaaccaggagaaagcaatgcaggtctctgggaatctcatcccttccataaggaaaatgctctgccaattcaagtttcattcagtcaggaagacagaaggatttaaggcttcggtgacaattataatcctctgagaaattatttccccttaaagtcaagataagataatagtgtttactgtactttctcttgactcttgaaatccctggtattgggtgtaggcaacttgcacctgcaatgaagtccgcaggagaggaaggtctctcctcccccgaaagctatcccaggtcacatgcgtggcgaatgcccactgaacctcggctctcatggaagcaggaaagacaccgagattcaagccttctagtaggttgaggacgctgtgctcatggcatcttcggagattttggtactggcaggggtggatgcttgcaaaatact

SEQ ID NO: 1061 - DNA, 267 bp, Homo sapiens
cctatggaggtgcctatgatgtcatgagctctaagcacctttgtggtgataccaactatgcctggcccaccgcagagattgcggtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttgg

SEQ ID NO: 1062 - DNA, 603 bp, Homo sapiens
  misc_feature 533, 592: n = A,T,C or G
ctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaaagtccggctggcgtnccccaagccctgagatgctctgtcaccttcaaaggatggtgtcagagcagtgccacctnctgtctcagtt

SEQ ID NO: 1063 - DNA, 222 bp, Homo sapiens
ccatcgtggatcactgagatgcagtggcggtccccgtagctggcccgtggcatgccaccctggaagatggtgaagggcaacccctgcctagtggtcagccggaggattctggtaatcgctttgcaaggaaagggaccgtaaggcacgaggctgcggaggggctctggttgctgggcttcgctggacacgggccactggcagtagctgccgtcagagtgacag

SEQ ID NO: 1064 - DNA, 72 bp, Homo sapiens
  misc_feature 13, 14: n = A,T,C or G
gatgatcaatatnnactggaacacatgcatgcttttggaatgtataattacctgcactgtgattcatggtat

SEQ ID NO: 1065 - DNA, 251 bp, Homo sapiens
gtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcag

SEQ ID NO: 1066 - DNA, 289 bp, Homo sapiens
ctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccagtgctcttggaggacccagtcctttgtgccttggcaaaaaagcacaagcgaaccccagccctgattgccctgcgctaccagctacagcgtggggttgtggtcctgg

SEQ ID NO: 1067 - DNA, 301 bp, Homo sapiens
ctgtagttgactgaagtcgctaaacaggacggatttaagtagaggtgatatgtccagtcaccggcatagagacgtcctctgcgtcaccatccacacacagggcttctggtagacatcaggcaaagctctccatgttaatattcatctgaatatggataattagggtggctagcaaaactatcactgttaaaatagtggagatttctgtctaggccatctatggctttcatgtcctccgcagtcaactggaactcaaaaacctgcacgttctgtctgatgcgctgctcattgtagctcttgg

SEQ ID NO: 1068 - DNA, 255 bp, Homo sapiens
ccagcagttcctctttgccttatatttgtggtacgcccggccagccttcaagatgggtttgtcaattcggccacctccagccaccacaccaaccacagctctgttggctgaggagataaccttcttggagccggagggcagcttcacacgggtcttcttggtctcagggttgtgggagataacggtggcatagttccctgatgcccgggccagcttgccacggtctccaggcttctcctccaggcagcacacgat

SEQ ID NO: 1069 - DNA, 77 bp, Homo sapiens
ctggacaggctccagcaccggcccaaacacgcccagacctcggcaggcaccacctggttctcccacccagaaagttc

SEQ ID NO: 1070 - DNA, 163 bp, Homo sapiens
  misc_feature 12, 108, 109, 137, 147, 148: n = A,T,C or G
ctgctgggatgnctgccaagtttttcagccataaggtagcgaaatctagcagaatccagattacatccacttccaatcacgcggtgtttgggtaatccacctagtttnnaggtaacatacgtaagaatgtccactgngttggaaacnncaattatgatgcaat

SEQ ID NO: 1071 - DNA, 246 bp, Homo sapiens
  misc_feature 14: n = A,T,C or G
ctgaccggaccggncatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagacaaaaaaaaaaaaaaaaaaacaaa

SEQ ID NO: 1072 - DNA, 224 bp, Homo sapiens
  misc_feature 143: n = A,T,C or G
ctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcangtaattattcgaggtggaggacatattttaccctatgaccagcctctgagagcttttgacatgattaatcgattcatttat

SEQ ID NO: 1073 - DNA, 301 bp, Homo sapiens
ctgtagttgactgaagtcgctaaacaggacggatttaagtagaggtgatatgtccagtcaccggcatagagacgtcctctgcgtcaccatccacacacagggcttctggtagacatcaggcaaagctctccatgttaatattcatctgaatatggataattagggtggctagcaaaactatcactgttaaaatagtggagatttctgtctaggccatctatggctttcatgtcctctgcagtcaactggaactcaaaaacctgcacgttctgtctgatgcgctgctcattgtagctcttgg

SEQ ID NO: 1074 - DNA, 132 bp, Homo sapiens
  misc_feature 41, 47, 56, 69, 78, 93: n = A,T,C or G
caagctttttttttttttttttttttttttttcgctcaaanactttnttttattantacatgggctggnattgatggnaagggacaaatgtanttggcaaccatggttagcatcggatgcccatcccaatgg

SEQ ID NO: 1075 - DNA, 301 bp, Homo sapiens; identical to SEQ ID NO: 1073

SEQ ID NO: 1076 - DNA, 436 bp, Homo sapiens
ctgctgggatgaatgccaagtttttcagccataaggtagcgaaatctagcagaatccagattacatccacttccaatcacgcggtgtttgggtaatccacctagtttccaggtaacatacgtaagaatgtccactgggttggaaaccacaattatgatgcaatcaggactgtacttgacgatctgaggaataatgaatttgaagacattaacatttctctgcaccagattgagccgactctccccttcttgctgacggactcctgcagttactactacaatcttagaattggcggtcacagaataatctttatctgccacaattttaggtgtctgaagaaataagctcccatgctgcagatccatcatttctcctttaagcttatcttccaaaacatccacaagagcaagttcatcagccagagactttcccagaa

SEQ ID NO: 1077 - DNA, 256 bp, Homo sapiens
ctgaagattaataggaaacagtgaaaaagcaacgtcctgtgatcagtaactttaaagacaagcttggttctctctttctggcactactgacattcccaccattctagcttccgaattctggaaaaagagaagatgattaacaaaaatagagaatgtagaaacttctggttttgtgcctacaggattggcaccagaccctcagtgctcacttgctccatctacaaggcagcacccctcccagaggcagccagggagg

SEQ ID NO: 1078 - DNA, 202 bp, Homo sapiens
  misc_feature 8, 10, 26, 67, 71, 77, 84, 93, 127, 133, 144: n = A,T,C or G
ctgtgctncncaaccagatccatgtnaagtgccccgcccagagaagggagccagggggagctgactncagncaacanccagtgnccggatgancaccaacatgtgaggggtgaaccttggcctccangacatntgcaccccctncccacctccacggacctcggacctccaggcggctcagtgctgcctgcggcccagctaa

SEQ ID NO: 1079 - DNA, 170 bp, Homo sapiens
gcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctgg

SEQ ID NO: 1080 - DNA, 494 bp, Homo sapiens
cctgcggcaaagagatgcgcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgaggaaagttgaagatgaattgaaagca

SEQ ID NO: 1081 - DNA, 123 bp, Homo sapiens
ctgctgctattaagttgcaagctctacagctagctacatgactgatggatcagtttgagatttgttcccttgtcaaaagtttaactctgatagaaggttggcctcacattctgatgtttggac

SEQ ID NO: 1082 - DNA, 297 bp, Homo sapiens; identical to SEQ ID NO: 389

SEQ ID NO: 1083 - DNA, 452 bp, Homo sapiens
ctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcag

SEQ ID NO: 1084 - DNA, 301 bp, Homo sapiens
ctgtagttgactgaagtcgctaaacaggacggatttaagtagaggtgatatgtccagtcaccggcatagagacgtcctctgcgtcaccatccacacacagggcttctggtagacatcgggcaaagctctccatgttaatattcatctgaatatggataattagggtggctagcaaaactatcactgttaaaatagtggagatttctgtctaggccatctatggctttcatgtcctctgcagtcaactggaactcaaaaacctgcacgttctgtctgatgcgctgctcattgtagctcttgg

SEQ ID NO: 1085 - DNA, 369 bp, Homo sapiens
ctgtttcccatgggccaccaggcggctcaggacagcaaacgtctcatcccctctcaggatgtacttctccatgtcctgctcgatccactggtacatgaggcccttcacatgcacgtctcggatggcgtccgtcacgtccttgtagagatgtgcttggtcaaactccaggctgtggcccagaaagtagtccaccacacaggacagcagagccatctccggtagcgagaagatgtccatgaactgcttaatggagggacccttgccatagaagccactcatctggtatagtgggatgtgctgggtacccccatacagctcaatcacctcctcgtctggcacaggctggaggcccctgtaggctgtccccag

SEQ ID NO: 1086 - DNA, 316 bp, Homo sapiens
cctcagaggtttctccacagtcctcttctgggcaaattcttgtttcttcacatgccggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgccgctgcaaggtggggaaactgtaagtgaacccctgtgggtgcgggggagggtatccggtgcgcagggaggtgg

SEQ ID NO: 1087 - DNA, 329 bp, Homo sapiens
cctgcaggggatgggaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctggttctctttggagctgtgatcgctggagctgtggtcgctgctgtgatgtggaggaggaagagctcagatagaaaaggagggagctactctcaggctgcaagcagtgacagtgcccagggctctgatatgtctcccacagcttgtaaagtgtgagacag

SEQ ID NO: 1088 - DNA, 342 bp, Homo sapiens
ccactcactgctgggacccaggcacctcccttctccatcctctctggattgtcagtaatgtcctggaacagaagcctgtgggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctga

SEQ ID NO: 1089 - DNA, 51 bp, Homo sapiens
  misc_feature 18: n = A,T,C or G
ccttgtgttcagtctccncgctcttcttgccactgttgagggtggagatgt

SEQ ID NO: 1090 - DNA, 515 bp, Homo sapiens
cctggggaggccctaggggagcaccgtgatggagaggacagagcaggggctccagcaccttctttctggactggcgttcacctccctgctcagtgcttgggctccacgggcaggggtcagagcactccctaatttatgtgctatataaatacgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagagggaaagttacagatttcctgtagcaggtgtgggcttacagacacatggactgg

SEQ ID NO: 1091 - DNA, 277 bp, Homo sapiens
gcgtcccggagcccacggtggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccag

SEQ ID NO: 1092 - DNA, 368 bp, Homo sapiens; identical to SEQ ID NO: 1044

SEQ ID NO: 1093 - DNA, 459 bp, Homo sapiens
ctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcacagagcccctgatgctgttgttctttgagggcttaagg

SEQ ID NO: 1094 - DNA, 610 bp, Homo sapiens
  misc_feature 590: n = A,T,C or G
ccatgcaaaaggaggtggtgcactcagtgcagtcgctgccacaaaaagtccgattattttcattggtacaggggaacatatagatgactttgaacctttcaaaacacagccttttattagcaaacttcttggtatgggcgacattgaaggactgatagataaagtcaacgagttgaagttggatgacaatgaagcacttatagagaagttgaaacatggtcagtttacgttgcgagacatgtatgagcaatttcaaaatatcatgaaaatgggccccttcagtcagatcttggggatgatccctggttttgggacagattttatgagcaaaggaaatgaacaggagtcaatggcaaggctaaagaaattaatgacaataatggatagtatgaatgatcaagaactagacagtacggatggtgccaaagtttttagtaaacaaccaggaagaatccaaagagtagcaagaggatcgggtgtatcaacaagagatgttcgagaacttttgacacaatataccaagtttgcacagatggtaaaaaagatgggaggtatcaaaggacttttcaaaggtgggcgacatgtctaanaatgtgagccagtcacagat

SEQ ID NO: 1095 - DNA, 232 bp, Homo sapiens
ccttatttctcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccg

SEQ ID NO: 1096 - DNA, 377 bp, Homo sapiens
ccacgctcatggaaaccacccaaggacagccagagtccacattccctggcaagctgggtgtattcttccaaaagtttcccacccagtggttcagacaggtgtagcgtctctgcagggtcccgtgcaatgaagtcaaatgcctcaggcaggaaagccaggcaggcacccagtctggcagcctctcgaaccagcccagcacatgttttaaagttctgttgcttgtctggcgtcgatgttacctggcacacagccaccaggggcagttcgcaggaggaagaggagatagccatggctctgggcctgggctgagcacaaagtactgagagttgaggtatccggagtccaggacacagaagggacaggaatctgtgaggagg

SEQ ID NO: 1097 - DNA, 311 bp, Homo sapiens
ccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtgg

SEQ ID NO: 1098 - DNA, 404 bp, Homo sapiens
ccacccacgcttaggttcccatcacactgatgactccgggtttggcgagcacaggagcgcaaaccttttcacattctttctgtgatccaaatttgttttcgtttccaccacaacctccataccagaatcttgcacagcttttggtgtttggatcatagtaccattttaatatgaaatccctgcaagttccttcgtctttcggcaacttgcatatatctgtttcagtgagagccaatggttctgtgctcaccattagattgatggttgaactagaagctgaccttgctggctgtggaggtgggggctgagatttctttgtactgaaacttccgtggtaggtggctctgacctgagacctcaggtagcagaccacagccacatggtatgtctgcccagcgagcagg

SEQ ID NO: 1099 - DNA, 442 bp, Homo sapiens
ccatgggatggctcttctgaccattgggggccaggccaggccaggccaggcttagggtagcaaggaccaggccaaaggggcagggcctcctttggaggggttgaggggtacatcctcggctggtgtttgcatccaggggtccagcaggatctcttccagtgagggtcgggaagaaggtttgggggccaggcaccggcggattagggcacagcagtctggggagacatgggctgggaagtggagctcagcttccagaatctcctggtccctctcaaagggaatgtccccacacaccatgtcatagaggaggatgcccagtgaccagacagtggccgggagtgcatggtactggtgtcgagagatccactctggggggctgtacacccttgtcccatcaaagtcagtgtagggttcatcatgaagcagggcaccaggaaccaaa

SEQ ID NO: 1100 - DNA, 191 bp, Homo sapiens
ccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccag

SEQ ID NO: 1101 - DNA, 178 bp, Homo sapiens
cgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctgg

SEQ ID NO: 1102 - DNA, 209 bp, Homo sapiens
agccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactgg

SEQ ID NO: 1103 - DNA, 396 bp, Homo sapiens
  misc_feature 351: n = A,T,C or G
ctatagggctcgagggccgcccgggcaggtggtgcctctaatactggtgatgctagaggtgatgtttttggtaaacaggcggggtaagatttgccgagttccttttactttttttaacctttccttatgagcatgcctgtgttgggttgacagtgggggtaataatgacttgttggttgattgtagatattgggctgttaattgtcagttcagcgttttaatctgacgcaggcttatgcagaggagaatgttttcatgttacttatactaacattagttcttctatagggtgatagattggtccaattgggtgtgaggagttcagttatatgtttgggattttttaggtantgggtgttgagcttgaacgctttcttaattggtggctgctttagg

SEQ ID NO: 1104 - DNA, 342 bp, Homo sapiens
  misc_feature 224, 226, 302: n = A,T,C or G
ctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcantnctttgccattggaggctccgggagctcctacatctatggctatgttgatgctacctaccgggaaggcatgaccaangaagagtgtctgcaattcactgccaatgctctcgctttgg

SEQ ID NO: 1105 - DNA, 551 bp, Homo sapiens
ctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacggaaaagactctgaccagagatcgagaccatcctagccaacatcgtgaaaccccatctctactaaaaatacagaaattagctggacatggtggcatgtgcctgtaatcccagctactcaggaggctgaggcaggagaactgcttgaacagggacccgggaggcggagattggagtgagccgagatcgcgccactgcactccagtctgggctacacagtgagactctgtctcaagaaaaataaacagaagaattgggggttgggggtgggaaacagtgtttccaggcagagagaacagcacgtacaaaggagactgttgggagggttaaatgaaataattcatgtaaggtacttagtaccacacatgaatttcacaagcagcag

SEQ ID NO: 1106 - DNA, 280 bp, Homo sapiens
ctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagggctcctgcacctcaacaatgtcagcactggctgcatcctgctgggcggactcttcatctacgatgtcttctgggtatttggcaccaatgtgatggtgacagtgg

SEQ ID NO: 1107 - DNA, 570 bp, Homo sapiens
ctgattagtgtctaaggaatggtccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagct

SEQ ID NO: 1108 - DNA, 386 bp, Homo sapiens
ctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacag

SEQ ID NO: 1109 - DNA, 409 bp, Homo sapiens
ctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctgg

SEQ ID NO: 1110 - DNA, 215 bp, Homo sapiens; identical to SEQ ID NO: 890

SEQ ID NO: 1111 - DNA, 308 bp, Homo sapiens
cctgggcccgctgacttcagggtgaggccacagctactgcagcgctttttatttatttatttatttactgagatggagtcttgctctgtcacccaggctggagtgcagtggtgcaatctcggctcactgcaacctctgcctcctgggctgcagtgattctcctgcgttcaagtaattctcctgcctcggccttctgagtagttgggattacaggcatatgccaccacacttggctaattttttgtatttttagtagaaatggggtttcaccatgttggcgaggctggtctcgaactcctgacctcaag

SEQ ID NO: 1112 - DNA, 177 bp, Homo sapiens
ccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtgg

SEQ ID NO: 1113 - DNA, 646 bp, Homo sapiens
  misc_feature 529, 580, 622: n = A,T,C or G
ccccaccatggacacactttgctacacactcctgctgctgaccaccccttcctgggtcttgtcccaggtcaccttgaaggagtctggtcctgtactggtgaaacccacagagaccctcacgctgacctgcaccgtctctgggttttcactcagtaatattagagtgggtgtgagttggatccgtcagcccccagggaaggccctggagtggtttgcatacattttttcgactgacgaaaaatccttcaattcatctctgaagaacaggctcaccatctccaaggacacctctaaaagccaggtggtccttagcatgaccaacatggaccctgtggacacagccacatattactgtgcacggctctctatttacttcggggagttagaaacctaccaatacatggacgtctggggcaaagggaccaccgccaccgtctcctcagcatccccgaccagccccaaggtcttcccgctgagcctctgcagcacccagccagatgggaacgtggtcatcgcctgcctggtccanggcttcttcccccaggagccactcagtgtgacctggagcgaaagcggacanggcgtgaccgccagaaacttccccacccagccaggatgcctncggggacctgtacaccacgagcag

SEQ ID NO: 1114 - DNA, 420 bp, Homo sapiens
tgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttgg

SEQ ID NO: 1115 - DNA, 416 bp, Homo sapiens
ctgaaagtttctaaaatagaaacctggtgcatatggccccaaaacaccacatgctttgattacactcagggagcatgagttgcctatttgggtgagaaaatcccatgttacagtgcgatcgctgggcacgttttggagtaattccagccactgctatgtaagtgtttttaattcaggggtgtcttctacgttttcatcttctgaatatcttgtgacggtgcaggtttgagcaaaactggcatgaaatgagagctgttttagatgaagattgcaagatggatggcttggcccacagtggcagtgggttgggggtggaatgtggacaattaggaaaaaggcatgtcattctatctggctcctggagaggcagatagtcctgggggctttggtgtcacagttcccaaaagcaaggttgg

SEQ ID NO: 1116 - DNA, 382 bp, Homo sapiens
ccttatttctcttgtcctttcgtacagggaggaatttgaagtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaaatttttaatgcaggcttggtagtttaggacctgtgggtttg

SEQ ID NO: 1117 - DNA, 370 bp, Homo sapiens
ctgcgtgtctgaaaaccaaagatttaaaacatagtaattattgaacctcagaagaaaaactcagattgaaagagcttagaataagaccctttttgagttgagaaaggtgagtacttagatttttcatttgctttgtttgggattacttacatcagtattttatgttgatcagaaagaaaggattcaattagctattgttcggttaataaaaatgtcagccactgtaggagtaagttggatgtccagcctttttagattgcttaacttggaaacactggactgggagcggtggctcatgcctgtgatcccagcactctgggaggccaaggcaggcagatcactggaggtcaggagtttgagaccaacctgg

SEQ ID NO: 1118 - DNA, 494 bp, Homo sapiens
ctgtctcttacttttaaccagtgaaattgacctgcccgtgaagaggcgggcataacacagcaagacgagaagaccctatggagctttaatttattaatgcaaacagtacctgacaaacccacaggtcctaaactaccagacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaaggacaagagaaataagg

SEQ ID NO: 1119 - DNA, 407 bp, Homo sapiens
ccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagtcggttgtaatgcagcctgagaaattccagtccaagtatgagccccggagccacatgatggacgtccagggctccacccaggactcggccatcaaggacttcgtgctgaagtacgccctgcccctggttgg

SEQ ID NO: 1120 - DNA, 548 bp, Homo sapiens
  misc_feature 513: n = A,T,C or G
ccccagaggacccgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatggcttcactcaagtctgttaatggacaaatagaaagcctcattagtcctgatggttctcgtaaaaacccagctagaaactgcagagacctgaaattctgccatcctgaactcaagagtggagaatactgggttgaccctaaccaaggatgcaaattggatgctatcaaggtattctgtaatatggaaactggggaaacatgcataagtgccaatccttngaatgttccacggaaacactggtggacagattcta

SEQ ID NO: 1121 - DNA, 278 bp, Homo sapiens
cggccgaggtccgccatggcgtgtgctcgcccactgatatcggtgtactccgaaaagggggagtcatctggcaaaaatgtcactttgcctgctgtattcaaggctcctattcgaccagatattgtgaactttgtttacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctgg

SEQ ID NO: 1122 - DNA, 591 bp, Homo sapiens
ctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcact

SEQ ID NO: 1123 - DNA, 454 bp, Homo sapiens
ccaattgaaacaaacagttctgagaccgttcttccactactgattaagagtggggtggcaggtattagggataatattcatttagccttctgagctttctgggcagacttggtgaccttgccagctccagcagccttcttgtccactgctttgatgacacccaccgcaactgtctgtctcatatcacgaacagcaaagcgacccaaaggtggatagtctgagaagctctcaacacacatgggcttgccaggaaccatatcaacaatggcagcatcaccagacttcaagaatttagggccatcttccagctttttaccagaacggcgatcaatcttttccttcagctcagcaaacttgcatgcaatgtgagccgtgtggcaatccaatacaggggcatagccggcgcttatttggcctggatggttcaggataatcacctgagcagtgaagccag

SEQ ID NO: 1124 - DNA, 219 bp, Homo sapiens
cctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaat

SEQ ID NO: 1125 - DNA, 246 bp, Homo sapiens
ccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggttcaaaagaaa

SEQ ID NO: 1126 - DNA, 227 bp, Homo sapiens
ccattgttcccgtgcatcgaagcttgcaggcagcttcaggtcctcggtaaacataactctctggggtggcttgggcccacccaggaaggtaccacatagcctcttcaagtagctcatgtccacgttgtagaagttgtggccggcctgccacgtggtattccgtttgttgacatagttgaccagctcatccgacaggggatggaaagagggcctgctccgggcattgg

SEQ ID NO: 1127 - DNA, 377 bp, Homo sapiens
cctgccgtcgatgccagggaggccgacaggaccttcttttccagcggggccgatatttccaggggaaccaggaagacctctgggtcccatgagaccaggctccccagggcgaccagcatctccattaggtcctcggactccagcagggccacttgcaccacgactaccaggagggcccatgacgccagctctgccatcagctccaggaagaccacgagaaccaggactacctctcagcccaggaggtcctggagggccggcagatccagcttccccattagggcctctctttccttcttcaccactgggaccaggaggaccttggggcccagcagagccgggctcacccttgttaccgctctctcctttggagccag

SEQ ID NO: 1128 - DNA, 253 bp, Homo sapiens
gagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacactgtcctttaaagtgctgcagtatgg

SEQ ID NO: 1129 - DNA, 314 bp, Homo sapiens
ccaagagctacaatgagcagcgcatcagacagaacgtgcaggtgtttgaattccagttgacttcagaggagatgaaagccatagatggcctaaacagaaatgtgcgatatttgacccttgatatttttgctggccccccaattatccattttctgatgaatattaacatggagggcattgcatgaggtctaccagaaggccctgcgtgtggatggtgacacagaggatggctctatgctggtgactggacacatcgcctctggttaaatctctcctgcttggtgatttcagcaagctacagcaaagcccattgg

SEQ ID NO: 1130 - DNA, 239 bp, Homo sapiens
ccagtccaacctgctcctcattattgtataaatgagcagaatcaatatggcggaagtcagcttcaattgccaatttggtggcctctaaagctttacttttaggaacctctgcaggcgcataggtgccaaatcccaggacaggcatgaagtgaccatcattcagcttcacacactgatatttcgaatccatttctgtcactagcctggctagcaaatgtttcttcctccctcacaggcta

SEQ ID NO: 1131 - DNA, 402 bp, Homo sapiens
aaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggac

SEQ ID NO: 1132 - DNA, 304 bp, Homo sapiens
ccaccccggagatgacacgaggctcacatgactctagacacttggtggaaagtgaggcgagaaaaacaatgacttgggccaattacacgactgcaaagctagagctgccaacagggctccagggagcttggcttctgtagaagttctaaggaagcggtacgaactccacggcggtggggcgctaactagcagggacccctgcaagtgttggtcgggggcctcgagctgcctgagctgacacgaggggaggggtctgtgtagccaacaggtgaccgaagggcttgcctgcccacagcttacttgg

SEQ ID NO: 1133 - DNA, 224 bp, Homo sapiens
ctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacag

SEQ ID NO: 1134 - DNA, 250 bp, Homo sapiens
cctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccagg

SEQ ID NO: 1135 - DNA, 315 bp, Homo sapiens
ccaatgggctttgctgtagcttgctgaaatcaccaagcaggagagatttaaccagaggcgatgtgtccagtcaccagcatagagccatcctctgtgtcaccatccacacgcagggccttctggtagacctcatgcaatgccctccatgttaatattcatcagaaaatggataattaggggggccagcaaaaatatcaagggtcaaatatcgcacatttctgtttaggccatctatggctttcatctcctctgaagtcaactggaattcaaacacctgcacgttccgtctgatgcgctgctcattgtagctcttgg

SEQ ID NO: 1136 - DNA, 377 bp, Homo sapiens; identical to SEQ ID NO: 1127

SEQ ID NO: 1137 - DNA, 250 bp, Homo sapiens
ctgttcaacttccaactctaaataggcaccattaaacaaaaaaccccagtattttaaatttctccagcacacattccaggatcaatgctctgaactgtaatcagctagtaattcataacgggaatacagccttagaatggaagctatattgcttccctgccccctttctcttacaattggagagtgtaggtattaagggatacaaagtcagaggaagaataattaaaaagaaaaatgcccaaagctgcag

SEQ ID NO: 1138 - DNA, 511 bp, Homo sapiens
  misc_feature 431: n = A,T,C or G
tcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaangaggaaagggtgctgctggtcctcctgggccacctggtgctgctggtactcctggtctgcaaggaatgcctggagaaaga

SEQ ID NO: 1139 - DNA, 505 bp, Homo sapiens
ctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattgtgcctgcaattaggcattggtcaggggtgaatggctcttttcacagagagtagccaaccagagacctttgctttgatatcatcaactgcagagaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacag

SEQ ID NO: 1140 - DNA, 256 bp, Homo sapiens
ctgtagcttctgtgggacttccactgctcgggcgtcaggctcaggtagctgctggccgcgtacttgttgttgctctgtttggagggtttggtggtctccactcccgccttgacggggctgccatctgccttccaggccactgtcacagctcccgggtagaagtcactgatcagacacactagtgtggccttgttggcttggagctcctcagaggagggcgggaacagagtgacagtggggttggccttgggctgac

SEQ ID NO: 1141 - DNA, 371 bp, Homo sapiens
ccagggccccattctgtctgtgggactgtgggttctcagtggaattgttgcctttcttgtcgtggagaaatttgtgagacatgtgaaaggaggacatggtcacagtcatggacatggacacgctcacagtcatgcacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctgg

SEQ ID NO: 1142 - DNA, 312 bp, Homo sapiens
  misc_feature 292: n = A,T,C or G
cctcccacactgtcaaatgtcaactccaccagcactgagacaatgagtagatgagaatgtagaaagagggaaggtggtaggtaaaggagcggaaggaagaggtggggaaagagggaaggtggtaggtaaaggagcggaaggaagaggtggggaaagagggaaggagagaagggaaggagggaagagaaagaaggaagaaaaggaaagcatggcccggctagagacaaagccagaggtgatcaggtcagcagcaggagaggctcagaagggagcctctcgggaagtgcaggcngccatgagggctcgtttcag

SEQ ID NO: 1143 - DNA, 367 bp, Homo sapiens
ccagacgtggtggctcacacctgcaatcccagcaccttaggaggccgaggcaggaggatccttgaggtcaggagttcgagaccagcctcgccaacatggtgaaaccccatttctactaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgactgagcaagactccatctcagtaaataaataaataaataaaaagcgctgcagtagctgtggcctcaccctgaagtcagcgggcccagg

SEQ ID NO: 1144 - DNA, 159 bp, Homo sapiens
cctggaggagcggccgcacacacagccaggcgctaggctccctgcgggacctcgggaagggggaagagcgtcaacgatttacggagggtccagccgctgggtcagattgagacaaaccattgtgtggttgggttcgggtcagcaggctggagagggttc

SEQ ID NO: 1145 - DNA, 450 bp, Homo sapiens
ccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcag

SEQ ID NO: 1146 - DNA, 324 bp, Homo sapiens
ccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctgga

SEQ ID NO: 1147 - DNA, 191 bp, Homo sapiens
ccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgtgctccag

SEQ ID NO: 1148 - DNA, 344 bp, Homo sapiens
ctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtgg

SEQ ID NO: 1149 - DNA, 329 bp, Homo sapiens
ctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctgg

SEQ ID NO: 1150 - DNA, 406 bp, Homo sapiens
ccagttatttgcaagtggtaagagcctatttaccataaataatactaagaaccaactcaagtcaaaccttaatgccattgttattgtgaattaggattaagtagtaattttcagaattcacattaacttgattttaaaatcagttttgtgagtcatttaccacaagctaaatgtgtacactatgataaaaacaaccattgtattcctgtttttctaaacagtcctaatttctaacactgtatatatccttcgacatcaatgaactttgttttcttttactccagtaataaagtaggcacagatctgtccacaacaaacttgccctctcatgccttgcctctcaccatgctctgctccaggtcagcccccttttggcctgtttgttttgtcaaaaacctaatctgct

SEQ ID NO: 1151 - DNA, 346 bp, Homo sapiens
ctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacag

SEQ ID NO: 1152 - DNA, 427 bp, Homo sapiens
ctggactgctgtacatcaaggacagattaactggaaaacatatgttccttatgcgtgatcgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacagagcccaacaatgatctcaggaattacattttccaacagaccaaaaaatgttttcatgtagcagcaatgcagatttggtgaatatttaatatatattttagtatgtatttcactttatgactgacaattaaaaaatattgtttgg

SEQ ID NO: 1153 - DNA, 331 bp, Homo sapiens
ctggccggcggtgcagatctggagtccagcctcagggatgcgctactttccattctctgcattgaacattcgttctgtcagcatccgctccagcttcactgcatcagcggcaaacttgcggatcccgtcagagagcttctccacagccatctggtcctcgttgtgcaaccaacggaaagacttctcatccaggtggattttttccaggtcactggcttgggctgggggacaagaaccagccttccatgcctgctccatgtccctgcccaccttggccccttgggctcagggcctgaaccgctgcacccaagcatctcccaccagggccagg

SEQ ID NO: 1154 - DNA, 403 bp, Homo sapiens
ctgaactttcagatgaagttgacttctacttgattgcaggattcagggtttctcagatgttaatacagagtcaaaagcggtggataaaaccttgcaaatggcttgtgcttgttccaggctgttgcactgataaacccacaggctgtattcctcattgcttgcatctgtggtcttcagagccagtaagctttttcccgcccccagaccgtcatcgtaacacaccatccggattattaagtagagagcatgcctgtgcaaaacatcatattgatctgatgttgatacttttatgccatacttggaaactcccataataaattcttcctccggaggaacaaaaggcaactttccatcttgctgggcaacgtctatataatttatcaggtctaatggcccttcaagg

SEQ ID NO: 1155 - DNA, 491 bp, Homo sapiens
cctccctctcagagcttgccccagggactctctggccctcagggttcaatgtattctgaccaaggccaagctttcctggggctcagggaaaatcacactttgctacccgaagctgtatcccctcagatgccaggaaggccgtgatcatctgactccaccctcctgagacacattctctccctgactgtcctgttctaagtcagcggagcaccttaggatggaggggtggaggcgaggccagatgcagcctctgtgaacaggtgcctggaggctgggaaatgaccctgagagggcaggacacagcaaccgtgggcttaaggtgaccttgagagcaagcttggcccactttacaattctgttcagagccagcccctaacatggtggtcatttattcatttgttccctcattttaaaaaatgtaaggccaggcatggtggctcacgccgggtaatcccagcactttgggaggccgaggcaggcagatcacctga

SEQ ID NO: 1156 - DNA, 586 bp, Homo sapiens
agcaaatagaagcaatcagggcactgcaagttgtgactactccaagatgtgaatcatggatcatgcaaattacaatcatgttttaacctgacctccaaagggagaataaagtaaaaattatcccatgtgaggattattcaccagtttatatgtcattagttaccagtttttctttatgaataatgtttagcaatattataaagtatatctaatagttatcaggtttttggcttgttactttttggtagtaacttataaaactgactggaaaagaccaataaggcactgtttgcatgttacaaattatatccaaagaccaaaagctgttaataagaaatcttccaataaaaccacatcatattttcttttttatttacacccacatcaggattacaactttatcaggactgcaccttgatcaggaagggatgtttctcttacaaggctaataagaaaggaacaataaatttgctgatgaaaaaagtcatgcatttaaaaattttaactttaatttttaattgagggcaatattttaaagaaatgctcattagtcattcctttaaattgtgtgtgtgagagagagaaa

SEQ ID NO: 1157 - DNA, 392 bp, Homo sapiens
  misc_feature 373, 389: n = A,T,C or G
cctccggctggtgttctgagggttgccaggccatcgtggacacaggcacctctctgctcactgtgccccagcagtacatgagtgctcttctgcaggccacaggggcccaggaggatgagtatggacagtttctcgtgaactgtaacagcattcagaatctgcccagcttgaccttcatcatcaatggtgtggagttccctctgccaccttcctcctatatcctcagtaacaacggctactgcaccgtgggagtcgagcccacctacctgtcctcccagaacggccagcccctgtggatcctcggggatgtcttcctcaggtcctactattccgtctacgacttgggcaacaacagagtaggctttgccactgncgcctagacttgctgnctc

SEQ ID NO: 1158 - DNA, 375 bp, Homo sapiens
gggaaaaataattttattcctcaaatgatcagcacattcagaagcaggacagaggagctctgatgacatctctgggggactcaaagcggccctcattttctggtattttcccaggtgattctcttccaacctgtgagtcctgctctctttcctcccatctgaagtttgagacatcctctgccacaaggaaagccaccaataccagcccaaagagccaccagagaggaaccaaaccacatgcatcaagttataggaaggatgcaagaagggaaattaggaaggaaagggaggagtttagttggcattctggggcatgctaacatgagggcgatggtctctctccaagtcgctggacatatcccttttctttccagg

SEQ ID NO: 1159 - DNA, 361 bp, Homo sapiens
  misc_feature 338: n = A,T,C or G
gtttattgtaaaaaacaaaaaactctgtattgtgcacatgaagacctggagatgtgccgacttcctgtccccaaagccaatcttccccgccaaggcgactgaggatttcaagggctcagagttactgcaggaatccaggtgacaccaggaagagaagggggaggaggggaatcggaggggatgggtttaaaaggcagaggggagggagatggaagggaatgaggaggagggagactgagggggctgcctttccttggggactggggaactcatgccctgcccccacccgcagggctccaggggtgagagaaaggggtggagaataaagaattgggcancagggtgatggggggaacagcag

SEQ ID NO: 1160 - DNA, 142 bp, Homo sapiens
cgcaatgttgccagtgtctgtctgcaggttggctacccaactgttgcatcagtaccccattctatcatcaacgggtacaaacgagtcctggccttgtctgtggagacggattacaccttcccacttgctgaaaaggtcaagg

SEQ ID NO: 1161 - DNA, 193 bp, Homo sapiens
ccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctgg

SEQ ID NO: 1162 - DNA, 265 bp, Homo sapiens
cctgggtgccacgattcccagcctggagcgcagccaggacgtgggagaccttctcagagactctccgggcacactctatgagctccttcttggtgtaggcatcactggggctgcactgcagggcgcctgccttggtgaccagagcggcacagccatggcccagctcctgtacccggtgtttgatatgggaacctatctcttcattttcagcagccaccgctgcaggcttggcctccgaggccagacggccatagtcactggtcag

SEQ ID NO: 1163 - DNA, 337 bp, Homo sapiens
  misc_feature 15, 204, 205, 212, 224, 263, 285, 293: n = A,T,C or G
ctgcagagtgggganaggcttttgccactagaaacttccaggatgcacgagatcaaggaattaagtctgtaacaaaataacaggatgctctgtgaagtccaaagaattgcttgaggcaaactgcagagctccatgagatcagcaaccccaagagcttttacaccgccggacacggtttaataggaaaaaaatctcctatactgnntattcanaaccaaatgaanagaaatgtcaaaggagtcggaaacaatatgtcaaattangtaaattcctgacctgacccanattttgcngaacatttgatcctaaactgtgctgtccacgtccttaggatcac

SEQ ID NO: 1164 - DNA, 368 bp, Homo sapiens
  misc_feature 221, 226, 233, 242: n = A,T,C or G
ccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcancccangaggcanaggttgcantgagccgagattgcaccactgcactccagcctgggtgacagagcaagactccatctcagtaaataaataaataaataaaaagcgctgcagtagctgtggcctcaccctgaagtcagcgggcccagg

SEQ ID NO: 1165 - DNA, 267 bp, Homo sapiens
  misc_feature 179, 211, 214, 235, 251, 252: n = A,T,C or G
ctgggaaggaggctcctccgccttctcctgtttgtcatcctcctcatcagactcgacctccatctcaacttcctcactctccccaaacttttcatagcgctcctgaatgaggattcgggcccccagctcctctggcgtggtggggggagggaagttcccttgctcattgggttggaagnccactgtttccaccaccacaaaatcatgccantcnatctgagcataggccacccgntccttctccttctccnnttcttccttcttcct

SEQ ID NO: 1166 - DNA, 433 bp, Homo sapiens
  misc_feature 142, 323, 354, 376, 381, 382, 402, 408, 422: n = A,T,C or G
ctgtctgtacactttttcttgggggaagagttcttgtcttcagtttactgcagtagggttcctggctctgttacatgctcatgtgttccggaagaacacatgaaatatcatcccacggatgacgatacagcccctgcttcancctcttctgatcaagatagtgtccaatgaaccccatactccttcccagcacaaagatgccattgagggctccaatgtcaatatattcatcagcttcctccctgcaacacacatcaacttgtagttttaaaaggctcacgtgactgccctcctccccacagacagtactactactgcccaanaatgagaagaaaaggggtgctctgggtggtngcattacaggcaatttttgttntcttnnttatacctctccttattttncaaatnttctattatgagtntgcattacttt

SEQ ID NO: 1167 - DNA, 362 bp, Homo sapiens
cctctggctctttcttcagccacttctccagctcctgcaggttctggtctgagtagtcagtgacgacgatctccttaaaggattcacaagcagagaggagctgatagatagtggggccagagccgatgtcaatcagcaggtctcccttcacaccgtctaggcagaatatcttgaaaagatttttcagaaggtgcttaagaatctggctttctgcagagtgcctagaaccaaacttgtaatatttttctaggtaatcccgagggttaaaatggcttagataggtgtccttggaggtgaagcctgattccattatgtctcacttccgtaccactggagcactgccctccttctctttcctccag

SEQ ID NO: 1168 - DNA, 459 bp, Homo sapiens
  misc_feature 370, 382, 406: n = A,T,C or G
gcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctncatggggcacanacccaacacaaggcggggatgctnccacgccacgtgcacacacacagacccacatgtgggtggggggcaccctcacg

SEQ ID NO: 1169 - DNA, 386 bp, Homo sapiens
ccaggccacctgtgcggggctcctcgatgtggaaggttcgggtgaggagattgtagaaggagccgtagcacacggccaccacagtgcacgtgaggcagatcacgctgtagggcatgctgaagtccggtgtcggcaggttcaccagcagcggctccgtgtagagccgcacaaagtagttagagccatcagagactgggaacaggctgttgaagaggggactctcttcccagtccactggcttggctgctaccatgctgggcacaagggcgctgaggacagatgggctgacatagaagccatggttaggatctggcgtgtactcggtccacttcagcagcgcccgctcaaactggatggaaaccttggtgactgagttggccggccag

SEQ ID NO: 1170 - DNA, 480 bp, Homo sapiens
ctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcaggaccagaacctgcaggagctggagaagtggctgaagaaagagccaga

SEQ ID NO: 1171 - DNA, 317 bp, Homo sapiens
cctcagcagccctgccacggatctgcccgattctttcgcatcaagaagttgatcttgcgagccatttccatgttgtagatccgccggcacctttcatagctttccctctgtcgccggcggcatggcttctcataataccgccgatgcttaatgtcctcaatgagcccatccatagtgaggattctgtttagggtcctgtatgcgctttccacgttcccttcctgtaccatcacagtcctggcgatgaacttcagatgttttgccatgaccttggatttaaaccttcactctgtagagcctcgcgcgctcagtaccta

SEQ ID NO: 1172 - DNA, 202 bp, Homo sapiens
  misc_feature 32, 62, 70, 71, 77, 90, 111: n = A,T,C or G
ggcaacgggaggaacagcagcagaggcagcangagcaggaggagcgtgaacgagaagagcancggcgatnngctgcnctcagtgaccganagaagagagctctggctgcanagcgccgactcgctgcccagttgggagcccctacctctccaatccctgactctgcaatcgtcaatactcgacgctgctggagttgtggggc

SEQ ID NO: 1173 - DNA, 173 bp, Homo sapiens
ctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacag

SEQ ID NO: 1174 - DNA, 301 bp, Homo sapiens
ccaagagctacaatgggcagcgcatcagacagaacgtgcaggtttttgagttccagttgactgcggaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacag

SEQ ID NO: 1175 - DNA, 537 bp, Homo sapiens
cctgcagggctcggccgtaggagaaggtcagggcccagggcttcagcagggggcacttgttaatggcattgaggttgatggacgcctcctcctcactctggcctccagacaggaaggtgatcccagtgacagcggggggcactgtgcggcgcagcgctgtgacggtcgccatggcaatctcctcatgagaaaacttctgagtgcaagcatggcctggggtgaccatgttgggcttcagcaaggtgccttccaggtagatgtggtggtcactcagagccttgtagacagcagccagcaccttctcggtcacatactggcagcgcttcaagtcatggtccccatcagggaggatctcaggctccacgatgggcacaatgccattctgctggcagatactggcataacgggccagaacattggcattttccatgatggcgagggctgagggggtgtgttccccaatcttcagcacacaacgccacttggcgaagtcagctccgtccttcttgtactgggcacagcgctcagacagcccat

SEQ ID NO: 1176 - DNA, 384 bp, Homo sapiens
  misc_feature 268, 285, 334, 360, 361, 368: n = A,T,C or G
ctgacaaaaaatgtgaaatttccacaaaatatccaacttatgtgactaaacgcagtagtttttttaaaaggggagatagaaaataaatggttttgttggagtgcattttagtaagcctttgcagtaaaatgacggttgtaactactaaaccaaatttagttttcacagcatggttttgttgttttccccttgtttttcagaggtaaattttgcattatatccttcagtattttaacactattttggcagtttacacattactttttgnttttccttcctttttgngaaatgtattaagttgtggttcttattgaaacagtattatataatgttngcttaattatatcatgtgatgctcanntctattntgatttattcattagt

SEQ ID NO: 1177 - DNA, 562 bp, Homo sapiens
  misc_feature 492, 541, 550: n = A,T,C or G
ccaacaacatgcaggaagctcagagtatcgatgaaatctacaaatacgacaagaaacagcagcaagaaatcctggcggcgaagccctgggctaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggnaaagtgaatcttggcgcctttaggacatacccaaagggctacaaacctnctgatgaangaccttctgagt

SEQ ID NO: 1178 - DNA, 353 bp, Homo sapiens
  misc_feature 117: n = A,T,C or G
cgcgtctggatggccgaatcattcgcacagactgggacgcaggctttaaggagggcaggcaatacggccgtgggcgatctgggggccaggttcgggatgagtatcggcaggactacnatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttgg

SEQ ID NO: 1179 - DNA, 288 bp, Homo sapiens
ccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgaggttgaccccatcaacgcactgcaggctgccatggagggctatgaggtgaccaccatggatgagg

SEQ ID NO: 1180 - DNA, 523 bp, Homo sapiens
ctggagagatggagcggtgggcaccgtcatccttcctcatcagccacatagaaggacagtggcgatttcagcccagcttttctgactgcttgtaaattgaagcccagaactggtttgccacctgtgggatcgactcagcattttaaaataggaggcagtcgtgagtgcaggtttcttgcagctccgggtggccctgggctccaggtcaggagacctcagctcctgtccctgatctgtggttgtcaagccttgcagactctaaactcagcatctttatctgtcagacgtagacacgtggctcccgtggttggtgcggttggaatagctgaggtaatacacggacctccaagcactagagcagtatgaggagttctgaggaatggttatcctgcggtgcctgtggtccacagcaagccattcttatcccatccggtttacttcccacagccactttgtaagcataggcattatcctctaccccatcatagaaatgaggaaaagaatcaccaagagagtaagcagc

SEQ ID NO: 1181 - DNA, 493 bp, Homo sapiens
  misc_feature 438, 479: n = A,T,C or G
cacagatgaaggctttgtgatacctgatgaagggggcccacaggaggagcaagaagagtattaacagcctggaccagcagagtaacatcggaattcttcactccaaatcatgtgcttaactgtaaaatactcccttttgttatccttagaggactcactggtttcttttcataagcaaaaagtacctcttcttaaagtgcactttgcggacgtttcactccttttccaataagtttgagttaggagcttttaccttgtagcagagcagtattaacacctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcanagaatgttgtaataagtaaatgccttaagagtatttaaaanatgcttccacattt

SEQ ID NO: 1182 - DNA, 329 bp, Homo sapiens
cgcgtctctgacactgtgatcatgataggggttcaaacagaaagtgcctgggccctccttctaagtcttgttaccaaaaaaaggaaaaagaaaagatcttctcagttacaaattctgggaagggagactatacctggctcttgccctaagtgagaggtcttccctcccgcaccaaaaaatagaaaggctttctatttcactggcccaggtagggggaaggagagtaactttgagtctgtgggcctcatttcccaggtgccttcaatgctcatcaaaaccaggcatggggaaggccctggcaaactgctccacccgttgcctgaggttgg

SEQ ID NO: 1183 - DNA, 198 bp, Homo sapiens
cctgacagacagaagggcttggagattttttttctttacaattcagtcttcagcaacttgagagctttcttcatgttgtcaagcaacagagctgtatctgcaggttcgtaagcatagagacgatttgaatatcttccagtgatatcggctctaactgtcagagatgggtcaacaaacataatcctggggacatactgg

SEQ ID NO: 1184 - DNA, 224 bp, Homo sapiens
ctggaggtgcctcagaaggtgcattctgcttcctgcaggggcttgaaacaccaaggcactccagggatcctggagtcaaagcagcagccccggttgttgcactccttgggggtgacatgggggtagccgcagtccaccctgtccttggctggcacggcacactggtttgcagacaggcccacgtactcctcagcagagctggaggacagcaaggccaggaccag

SEQ ID NO: 1185 - DNA, 367 bp, Homo sapiens
ccttttacagatgtcagctttcactggcctccatgcacaacctcccactaccacccaatctgcctgccacagcaaagtgcaggcaccctgggccccctggaggatgcgggcaggggctacagggcatccaggatgtggtcgatcttggtgaccagctcctggcgctttcctgagatgagcttctcattctcaatgtacgtgtctttcttgagcttgccagccaccaggcgctcagcctccaccgccgacttcagcaccagctccttgacctgtgcatccagcttctgcatttcgctcactctgtcgcacagatcagagccctctgtcttcagcctggactgcagcagtgcaatctcactggtcaagg

SEQ ID NO: 1186 - DNA, 188 bp, Homo sapiens
ccattaagcggatgctggagatgggagctatcaagaacctcacgtccttccgacctgggcaagagctgtagcctgtcggttgcctactctgctgtctgggtgacccccatgcgtggctgtgggggtggctggtgccagtatgacccacttggactcaccccctcttggggagggagtcctgggcctgg

SEQ ID NO: 1187 - DNA, 379 bp, Homo sapiens
gttgatgctactctgaagtctctcaacaaccagattgagacccttcttactcctgaaggctctagaaagagcccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctgg

SEQ ID NO: 1188 - DNA, 384 bp, Homo sapiens
cgcgtcggactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatgg

SEQ ID NO: 1189 - DNA, 419 bp, Homo sapiens
  misc_feature 348, 349: n = A,T,C or G
ggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttgagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtnnacttccagcttttgattgaaagtcctagggtgattctatttctgctgtgatttatctgctgaaagctcag

SEQ ID NO: 1190 - DNA, 173 bp, Homo sapiens
ccaggtactggcacatcatgctctggatgggggtggtggtgtcctgtaggcagagaaacaggaaattgtcgtagtcagtatcgagcagcgtggcctcgttcgccaccgtatagttgatcttgaacttctttggattctcagtcttctctccaaggaccttcttctcaacacag

SEQ ID NO: 1191 - DNA, 341 bp, Homo sapiens
cctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgttcttttctccaagtccaccagtctctgaaattagaacagtaggcggtatgagataatcagga

SEQ ID NO: 1192 - DNA, 324 bp, Homo sapiens
ttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacag

SEQ ID NO: 1193 - DNA, 521 bp, Homo sapiens
ctgctttgttttctgttggcagtggagggacaaggtgagaggagccaggggtagtcatgaacaccagtgggttctgccctgggcagctccccaccttctttaagagagtactgtgtctcagctccagcagtctcaactgggaagacccaggactcctgctcttttctctaatccctgggagacgaggtccagctaaggtagagtaagcagtcagtgaccaggcaggctggtttgggaggtcactgcctggaggacgggatcttgtattcttcggaagatggctgggaaattcttccctccattacgtagaactttcttcccctcctcagttgaggtgcctagatgtcccacaacggggtcttcactcaggtcctccagaggcacacgctcaaacagtgggtgctcttcgaaatgagtgcacatccagtcgtgtagctccagcacatcggttatggtatacaccagcccctgcataggcaaaatcaccctagacaggaggctgcatgcaacgtcagcagcca

SEQ ID NO: 1194 - DNA, 208 bp, Homo sapiens
ccagtgactagaaggcgaggcgccgcgggaccatggcggcggcggcggacgagcggagtccagaggacggagaagacgagggagaggaggagcagttggttctggtggaattatcaggaattattgattcagacttcctctcaaaatgtgaaaataaatgcaaggttttgggcattgacactgagaggcccattctgcaagtggacag

SEQ ID NO: 1195 - DNA, 499 bp, Homo sapiens
ccagaaaggaaagacaataattttgttttttcattttgaaaaaattaaatgctctctcctaaagattcttcacctactttggtctccataacttctatgttttctttccttctgacacactagtgcccctaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggttagggagatgggagggcaccaggaaaagtgattagaagtcaggtatgggaaggctaaattaggacagagtcgagtacatctctgct

SEQ ID NO: 1196 - DNA, 455 bp, Homo sapiens
ctgacccccctttgtccacagctaagatggcagcagaatgctatgtcactatatacagaaacaagacaacctgaagctaaatggatgccccctgcagagtcaacaggtccagcctcacagtgcacgccctgagctacagcctctcccaaaaggcatcttccccacagcctcaacgccgagcaaggagcatcaagggtttgtctcggttgttttgttctttttacaaactatagatatatacagttgaaaactcaggatttctagccaataaccatagttaccaccaccttacaaataaaaagaaaatgccagaaacatctttaaatgccttgtcacaccaacagcaaagtgcacagagtgaggagaacacgagagtgccttttcattttaaaaatgtttggaaatatgtacaacttcgatacagtttcagggtgctccagacacccatggacctg

SEQ ID NO: 1197 - DNA, 444 bp, Homo sapiens
cctggatgtggctcttcgcactgaaggccaagtagtagatcacaaggccgatcgccgcagccagcacctcagtggacacccagggcccgttccaagtgccccgatggtccacgctgactgtaaacagaggcgggatgatggaaatgtcctcgttattcctctgagccttcctgaggaggctgtaggactcctcgtcgaagaatctaacctcataggtgcctgcgtgggcgctcttgtggttcaggcttcaggacacctgataacgccccacatcctggcctcgagtgacagggaattgttttccaccgacgtcagcatagagagccatgttctggaccctgttcttgcatgtcagggagatctccacaatgaagacggtctcagtggaaatgacagcgtcagaagtggtgtagtaggaaggggtgatctggggctccaggcagg

SEQ ID NO: 1198 - DNA, 450 bp, Homo sapiens
ccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactccgcagggggcatccatttagcttcaggttgtcttgtttctgtatatagtgacatagcattctgctgccatcttagctgtggacaaaggggggtcag

SEQ ID NO: 1199 - DNA, 294 bp, Homo sapiens
agtcacagttgcacctattcaaaactagctttaaagtgagctatttttaaacttcataaaaatattcatgattttattagtttgaatatttctacaagattcgggtgggcttttcctttaggtgaaaacagctatccactcctgtggccttataactcaggaaatgctggggatgcaaacgtgcaaaaggcagggggaagctgcccaggctgagactggagcagctaggagtgtgcttggggaacgggagctgagatcccggagcagaaatggtcagccgtgctctggagcagg

SEQ ID NO: 1200 - DNA, 258 bp, Homo sapiens
agctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtagg

SEQ ID NO: 1201 - DNA, 403 bp, Homo sapiens
ctgagctgctgtctgctttggaaaaccgttcctgccgctgccgatggatggaaatgcaatggatttcagcttcttatcatcagccagggccaagcagtttttcactgtcttttccagaagttcttcacacttgtctgcaccccaaactggactattacagtggatcacaaacttggcaggcaggccatggcctgcgctgacagcagctccagctacttccaagggcccgttctttttccggagttccaggacagcttccacaaactccttgccacctttcttctccagcgtgtttcctaggtcatctttaaggtcaatgtcagcattggtaggattgattatggcctccacctcaaagccggctaaattactgatttcactgtgaataaggttcggcttctgg

SEQ ID NO: 1202 - DNA, 325 bp, Homo sapiens
ctgaacctgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccttgaggccctgcccaacagggtcaccgagaggaccgtggacaagtccaccggtaaacccaccctgtacaacgtgtccctggtcatgtccgacacag

SEQ ID NO: 1203 - DNA, 518 bp, Homo sapiens
ctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaaccagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctg

SEQ ID NO: 1204 - DNA, 352 bp, Homo sapiens
ggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccagga

SEQ ID NO: 1205 - DNA, 250 bp, Homo sapiens; identical to SEQ ID NO: 1137

SEQ ID NO: 1206 - DNA, 275 bp, Homo sapiens
  misc_feature 10, 11, 13, 236, 237: n = A,T,C or G
ctgctctcgnngnctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccnnacaggccccattgtgtggggggagccagggaccaatgg

SEQ ID NO: 1207 - DNA, 182 bp, Homo sapiens
ccatctcctgctcgaagtccagggcgacgtagcacagcttctccttgatgtcgcgcacgatttcccgctcggccgtggtggtgaagctgtagcctcgctcagtgaggatcttcatgaggtagtcggtcaggtcccggccagccaggtccagacgcaggatggcgtgggggagggcgtagccc

SEQ ID NO: 1208 - DNA, 260 bp, Homo sapiens
  misc_feature 130, 154, 167, 176, 240: n = A,T,C or G
gctggttatgaactcctgacctcaagtgatctgccctcctcagcctcccaaagtgctgggattataggcatgagccactggaatttttctttttttttttctttctttttttttttttttttaaattganacaaggtctggctctatcgcccangctggagtgcagnggcaccatntcggctcactgcaacctctgcctgctgggctcgagccatcctcccacctcagcctcccaagtanttgggactagaggtatgcac

SEQ ID NO: 1209 - DNA, 487 bp, Homo sapiens
aaacccactccaccttactaccagacaaccttagccaaaccatttacccaaataaagtataggcgatagaaattgaaacctggcgcaatagatatagtaccgcaagggaaagatgaaaaactataaccaagcataatatagcaaggactaatccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagta

SEQ ID NO: 1210 - DNA, 216 bp, Homo sapiens
ccactcagctcagcgggcgacgtgcccctacaagttggcagaagtggctgccactgctgggtttgtgtaagagaggctgctgccaccattacctgcagaaaccttctcataggggctacgatcggtactgctagggggcacatagcgcccatggatgtggtaggtggggtactcgctcataggatggtaggtatcccgggctggaaagatgtccag

SEQ ID NO: 1211 - DNA, 443 bp, Homo sapiens
ccaaggtcagaggctgatgcaacaggccctcttctccccagggccaggctcctgtccagcctgggcactgcccagagtgatggcattggtccggatgctgttctgtctctgcttggacaccttcgcaaagatttctttcaggacagtctcaaaggctagctcaacattggtagagtccagggctgaggtctccaggaagagcagtccattgttttcagcgaacattcgggcctcctcagtgggcacttcccgggcctggctgaggtcacttttgttacccacgagcatgacgacgatcgtggcttcagcatggtcatagagctccttcagccatcgctccaccacagcataggtctggtgcttggttaggtcaaacaccaggagggcccccactgcaccacgatagtacgccgaggtgatggctcggtaccgctccaggccag

SEQ ID NO: 1212 - DNA, 526 bp, Homo sapiens
actgaaacccgagtaaatgctcaggctgctgcatatgaatacatggctgcatacatagaaaatgcgaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaag

SEQ ID NO: 1213 - DNA, 359 bp, Homo sapiens
  misc_feature 15, 255, 258, 321, 322, 357: n = A,T,C or G
ccagccattgcctgncatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattantangaaaataagtcttttcatgcttatgatttagctgttttgtggtaattgctttttaaaggaagnnattaatatcataagttattattaatattgtgaacnca

SEQ ID NO: 1214 - DNA, 428 bp, Homo sapiens
ccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcag

SEQ ID NO: 1215 - DNA, 414 bp, Homo sapiens; identical to SEQ ID NO: 1005

SEQ ID NO: 1216 - DNA, 162 bp, Homo sapiens
  misc_feature 118, 119, 148: n = A,T,C or G
cctggccgcagggtcccccggtattgctgttgctacgaggttggggggcagcgattgtcctgtgggagccaccgttctcctgggtcggggaccctcacttcttctggggtgtgctcannttctgcatgccccggatcttgtccagcangccagaaatgaagg

SEQ ID NO: 1217 - DNA, 392 bp, Homo sapiens
  misc_feature 306: n = A,T,C or G
ctgaagtagaggctggaactgaagctgagactgaggctgaggctgaaactggagctaagggtgaggctggaactggagctgaggttgaggccagaactggagctaaagttgaggctggaaccggagctgaggttgaggctggaactggagttaaggttgctggaagtggagctgaggttgaggctggaactgaagctgaggttgaaggtggaagtggagccgaagctagaggtggaactgaggctgaagactgtgcttgctggatccctgtagcctgttttttggcaaatcttggaggaagcttanaagtctggcttcttcctttttcatttgcattctttttgttccagaccttaaaaaattaacggggaccatttttgtcaataatgcag

SEQ ID NO: 1218 - DNA, 526 bp, Homo sapiens
  misc_feature 379, 447, 470, 501: n = A,T,C or G
ctgagctttcagcagataaatcacagcagaaatagaatcaccctaggactttcaatcaaaagctggaagtccaccttacagaaagacaaaaagaaacccctttttatatcttaacaaagcaatagctctcaagcagcagagcatctcgaggaagaaagcttgcccggtcgccatcccatcatgccagagcgtgcagtgtccacccttgactacgctggggaattgctgattttttgaaaaagcttaacttaacaatttctgatgtctatcctttagagttctgtatgttcccattttttattcttctgaattttgaattgcaagtagctgtaaaatccaatctttgagtgcatgggggtgggtgtgaggcggggctcancttcaaccccctgtcctgtaaagcagtggctggtttttcctgagcccagccctgggaggtcgtggtangtgtggaggctgcagagctcctncagatgctgccctcgctgtgcctcacaccanagaggatggaagtgggctctggtgt

SEQ ID NO: 1219 - DNA, 382 bp, Homo sapiens
ctggccggcggtgcagatctggagtccagcctcagggatgcgctactttccattctctgcattgaacattcgttctgtcagcatccgctccagcttcactgcatcagcggcaaacttgcggatcccgtcagagagcttctccacagccatctggtcctcgttgtgcaaccaacggaaagacttctcatccaggtggattttttccaggtcactggcttgggccgccttggctgagagcacaggcaccagcttggcgttgtcctgcagcagctctcccaggagcttgggtgagatggtgaggaagtcacagccggccagtgctttgatctcgcccgtgttgcggaaggaggcgcccatgacaatggttttgtagctaaacttc

SEQ ID NO: 1220 - DNA, 127 bp, Homo sapiens
tcgacctccttgaagcagaccaagtatagcaagcctctaaaaggactactgagaaacagaatcagaaactctagaactctagttagggcccttcagcagggctgcagagcctccctggatacccagg

SEQ ID NO: 1221 - DNA, 304 bp, Homo sapiens
ccaccccggagatgacacgaggctcacatgactctagacacttggtggaaagtgaggcgagaaaaacaatgacttgggccaattacacgactgcaaagctagagctgccaacagggctccagggagcttggcttctgtagaagttctaaggaagcggtacgaactccacggcggtggggcgctaactagcagggacccctgcaagtgttggtcgggggcctcgggctgcctgagctgacacgaggggaggggtctgtgtagccaacaggtgaccgaagggcttgcctgcccacagcttacttgg

SEQ ID NO: 1222 - DNA, 309 bp, Homo sapiens
ctgtcgcactcgtagctgcaactcactcaacttgtctttagcagcaatttctgcatagtcattggcatgttcacctacctggatgtccgggtgaactctcagcatgcctccagcaaagagggagaacttggtggaattggagtgaagacagatctggtgctcaccaggggtatgggaagtgaaagtgaacctgccctcggagccatactgccgggccaggatgaccttgtcctctgggtcctccacctccacaaacatgccaagccccggggtggccggctggtactcctcccgctgcttgtcatacag

SEQ ID NO: 1223 - DNA, 390 bp, Homo sapiens
cctggcctgggagccctgtgcctactagaagcacattagattatccattcactgacagaacaggtcttttttgggtccttcttctccaccacgatatacttgcagtcctccttcttgaagattctttggcagttgtctttgtcataacccacaggtgtagaaacaagggtgcaacatgaaatctctgtttcgtagcaagtgcatgtctcacagttgtcagtctgccactccgagtttattggtgtttgtttcctttgagatccatgcatttcctggttgaatctcctggaactccctcattaggtatgaaatagcatgatgcattgcataaagtcacgaaggtggcaaagatcacaacgctgcccaggagaacattcattgtgataagca

SEQ ID NO: 1224 - DNA, 407 bp, Homo sapiens
ccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttgg

SEQ ID NO: 1225 - DNA, 250 bp, Homo sapiens
ctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctgtttagagttggaagttgaacag

SEQ ID NO: 1226 - DNA, 444 bp, Homo sapiens
  misc_feature 427: n = A,T,C or G
cctttaggctgttgctctgggcagggggtgggggtgcgggggcttacagtgggggcccttagttggcacaggttcggaagggccccaggcagacatgaattctcctgagacttgaggtaggttgcttcagccagcccgggcggagaagaagggcagagagcgaacataggagtccagtcgggagcgaaagagctcactttgcacagtttggcccagcgggcacaggggattcttcaccaccagctccacatacagcgcactgtagatgtggtgcagcacatctcggatgggtcccacgcccaagtcagtattcatgacaactttgatcccagtgggcgtctcgtagtaatggagtttgtaacggctagtttggaaggccaggaagccatccttcatgtctagcggggacatcttgctgacaaacgancggatagagaagagcat

SEQ ID NO: 1227 - DNA, 491 bp, Homo sapiens
gttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgctttttttttttttttgaggtagagtctcactatgttgcccagactagccttgaactcctgggctcaagtgattctccctcctcagcctcccgagtagctggaacgaactatagttgcaccactgcag

SEQ ID NO: 1228 - DNA, 279 bp, Homo sapiens
ctgggcggatctgatcaactaggcaacatcatgtccggatatgagttcatcaacaagttgactggagaagatgtatttggaatcaccgttcctctaattacaagtacaactggagcaaagctgggaaagtctgctggcaatgctgtttggctaaacagagataagacatctccatttgaattgtatcaattctttgtcaggcaaccggacgattcagtggaaaggtacctgaagctgttcactttcctaccccttccagagattgatcatatcatgcag

SEQ ID NO: 1229 - DNA, 199 bp, Homo sapiens
cggccgaggtccagtccaacctgctcctcattattgtataaatgagcagaatcaatatggcggaagccagcttcaattgccaatttggtggcctctaaagctttacttttaggaacctctgcaggcgcataggtgccaaatcccaggacaggcatgaagtgaccatcattcagcttcacacactgatatttcgaatcca

SEQ ID NO: 1230 - DNA, 237 bp, Homo sapiens
  misc_feature 9, 12: n = A,T,C or G
ctgcattgntgnggaattcacaactactcaggctgggaaaatacagattggttcaaagaaaccaaaaaccagagtgtccctcttagctgctgcagagagactgccagcaattgtaatggcagcctggcccacccttccgacctctatgctgaggggtgtgaggctctagtagtgaagaagctacaagaaatcatgatgcatgtgatctgggccgcactggcatttgcagctattcag

SEQ ID NO: 1231 - DNA, 277 bp, Homo sapiens
ctggaggtgcctcagaaggtgcattctgcttcctgcaggggcttgaaacaccaaggcactccagggatcctggagtcaaagcagcagccccggttgttgcactccttgggggtgacatgggggtagccgcagtccaccctgtccttggctggcacggcacactggtttgcagacaggcccacgtactcctcagcagagctggaggacagcaaggccaggaccagccccagcatgcagagcgctctggcagccatgaccaccgtgggctccgggacgc

SEQ ID NO: 1232 - DNA, 348 bp, Homo sapiens
ctgcaactttttttttttgcaattacagagtggtattcagttaacagaacaacaattatttcgtataagctgcatcagagacaactgaagatgaaaaaactaccatccccatatataactaatttgtgctgtgcaccaacaagaacctgctttaaatttccatgccaatttacaacccccatactgtaccaggcaaggttagtggctattgaaaataccaccaggacagggctatctaaagacacattcggtagtgtgttaactatacaaaaaaagacactgtacagtttaaaaacaaatcttacacagccttacatttcaatttttttctttaaaaggagtgagttg

SEQ ID NO: 1233 - DNA, 312 bp, Homo sapiens
  misc_feature 160, 163, 241, 302: n = A,T,C or G
ctgagcgtacggccgcgttcatcccagccgcgggtgcccccacgttgatgacagctacgttgcaattggtctttgggatctgatcatccggcagcttgatggcaagtcgcttgtaggtgttcaggttgcccgcaaagctcctccctcggagtcgaaccgnatnttgaaatctcctctcgtccatcgccttctgcacatcctgagtcatctgcacgcactccatcagcggcaggcgcacggngtggttcccgttcagtgacacgacgcaagctggggtgtccggggtggcctctagcaaggcnatgactgcct

SEQ ID NO: 1234 - DNA, 151 bp, Homo sapiens
ccggccgcgggcataaaaggcgccaggtgagggcctcgccgctcctcccgcgaatcgcagcttctgagaccagggttgctccgtccgtgctccgcctcgccatgacttcctacagctatcgccagtcgtcggccacgtcgtccttcggagg

SEQ ID NO: 1235 - DNA, 250 bp, Homo sapiens
  misc_feature 10, 15, 17, 107, 161, 189: n = A,T,C or G
ctgcaccttngggcntntttctttttaattattcttcctctgactttgtatcccttaatacctacactctccaattgtaagagaaagggggcagggaagcaatatancttccattctaaggctgtattcccgttatgaattactagctgattacagttcanagcattgatcctggaatgtgtgctgganaaatttaaaatactggggttttttgtttaatggtgcctgtttagagttggaagttgaacag

SEQ ID NO: 1236 - DNA, 154 bp, Homo sapiens
ctgatcctcactattgtgggcaccatcgctggcatcgtcattctcagcatgataattgcattgattgtcacagcaagatcaaataacaaaacgaagcatattgaagaagagaacttgattgacgaagactttcaaaatctaaaactgcggtcga

SEQ ID NO: 1237 - DNA, 375 bp, Homo sapiens
ccactggatctttgggattaaagctctgttggatttgtacctcagaggaagatcaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattg

SEQ ID NO: 1238 - DNA, 454 bp, Homo sapiens
gtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattccggaagagagtgagaacctgcacaacgctgaccagccactgcgtgtccgtggctgcatcctaactctggtggaacgaatggatgaagaatttaccaaaataatgcaaaatactgaccctcactccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagac

SEQ ID NO: 1239 - DNA, 483 bp, Homo sapiens
ctgccaggctgaaaagaagcctcagctcccacaccgccctcctcaccgcccttcctcgggagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgat

SEQ ID NO: 1240 - DNA, 358 bp, Homo sapiens
cctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcratgcctttmtsatamstgaccacactgasggcgaattmcagcacactggcggccgttactagtggatccgagctcggtaccaagcttggcgtaatcatggtcatagctg

SEQ ID NO: 1241 - DNA, 194 bp, Homo sapiens
ccaaaggttcgtaatgccatctctgcaccaatctcctcccccatagcaataagggcaatccccagaacagccactccctgatgtgctcccatgtcagcaggggcttccttcttgtccttgtctttcttttccttcttgtctttgtcttcctccttctctttggagtcaaagtgttcgctacaaatgtggagcag

SEQ ID NO: 1242 - DNA, 316 bp, Homo sapiens
ccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgacc

SEQ ID NO: 1243 - DNA, 275 bp, Homo sapiens
aaaagggtgatgaaagtattatgtataatattataatggtaaatatgtgatatgaatttgttgaaatcaacagaatatacagcataaagggttaattccaattcacaaaaatataaataaataggagattaggaattccaggatagaatgcagacaatatagaaaatatctaatgtcattacaaatgtatgaaatcagaagaggtgccaagtgacctcagaaatagtgtagtcaataaaagaataaagaaagtgcacgtcagaactgtaccccag

SEQ ID NO: 1244 - DNA, 235 bp, Homo sapiens
ctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtcttt

SEQ ID NO: 1245 - DNA, 640 bp, Homo sapiens
  misc_feature 565: n = A,T,C or G
ctgatgatgttccacaaaagagcaaaacatacacaatctggttccactctacagaaatcctggaactggactacaaagggaatagacagggtgtggcaggagggggttcctcacggttggagtgcgaggttagggacaggaatagaaggyaggtaataaacattcatgtggtattaacagggcagatgtgtcaatrtatttscaagtttagcataatataggtataaaaattaaataaaaatagtttakatgtgtgtgtatatatgggttaatacacaacacatacctcctagagtcattacctgagaggttctacaagaaaagacagcaaattaacaaaaaatacacccagaatcaagatttgagttttggttcctttcatagcagaatggtatgcaacatttcttggaaaaatggctaatcctagggcttggaaagagaatataggagtaaagtctacaatttctcatggtacccagaaaataagaaagggttccaaaatgaagaatcgctccttttgcaaaccttatggtaacaaatataatatttataaaaagtgaattangtaatatgttaatggagaaataaacatcattatgaaatgctatcttaacaaaaaatargagaaaatwttagtttt

SEQ ID NO: 1246 - DNA, 509 bp, Homo sapiens
aaactttcaaagaatcacttttaggcttacaaaaataaatatttgtcaaaatgttcaataaatattacataaaactagcagcaaaaagtatctagaaatctgtcgtgtgcaaatagttttcttcccaactatcattcccatggtcccaaataaattttagaatctagtcccatccccttcctagacaagctgcgttcaacaatctccaagagacaaagtaagattggaagtttaaggacacgcacacaagacatatatataaaattctctgaatgtgcaataaaagaagtactttgtaaaaagttatgggcaaaatgtacaagggcctaaacctagactaattgaaatagcaccataacaaatgacctcaatactgtcaagtgcacctacttaataaaagttttagaacaaggcacaatacacttgaaaatctattgcactttaggaaatttttgccgtcttcctatgccactgtaaaaagatggagcgttttgatcaccgcattctgg

SEQ ID NO: 1247 - DNA, 310 bp, Homo sapiens
catatgtggaactattcttggaaagtctacaaagtgaaatctatcgagttatttctcatttgcaaagtgatcctttgagtcatttctcataatctataatctgaatgttaatactgatatttttaaaagccctacatcccaacagaccaggccatctagatatttcagcgtggtgtctcaggatgagtaaacaaacagctaaaaatatatgacttatgtaaactagagttacaggagttactagcttttctgaaagggatatattctaagtattttttcttaaaaaaaaaaaaargggggggggggggtt

SEQ ID NO: 1248 - DNA, 640 bp, Homo sapiens
  misc_feature 604: n = A,T,C or G
aaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagtttttggnatataaatatgtaaatacatgctttaattgcaattt

SEQ ID NO: 1249 - DNA, 1108 bp, Homo sapiens
  misc_feature 527: n = A,T,C or G
caaaataaatttcaattcaatgaaaagtaaataacttagggatctataaatgacactgcaatgtatcttgttccatttttaacaggaagtccttcatgcaaatgtgtgagtctcccaggatgcatgaagctccagccttttcgtggtgactcaatagagcaattgtaccttacaaatktgcaaccacctccctgaaagtcttctcccacgttattaagtgcaatgyttatggtaaatgtagaagcatcatgatgaggacgaagagaacgctgtcgttcaggggagtattttactacaaaattcagtagtgcaaatcccttcgtataatagcctgcaaagaccttcagtgtaactggtgcaatgaactcccggataaaatgaagccatacattctccagatcaacttgcttcatgtggatatcatcagttgggacattttcataaccaccagatatacggctatcatgatgtttttccccagaccatttgccgtaatgttccatttcttctaccaattcatcacaggnctttttcagaaaatatggggaaccmaaaagacatctggacagggctgttcaamctatattttcagtgaaaatctttgaataatccmcggtttatatacttttccttccagtccacaggattttcaaaaatctgccagaggtcattgttataatgggaagtattgtaattagcagtggataatagccttccaaattcatgtctattagaaatgtacataaatacaccctttggggggctgagcatttggaatgtttccggagtaggggagtctttttccctttgtaaagtcatttctctagcatttcggcaaagagccatatcaggatccagtttatcacgaacaaaatagctcctttcattcatctctgatcggagtgtctttcctttaattaagtacacattagccatatatgggacattccatactcctactctattcccttgaacaatatccacataatcttcagatcgtgcatagtatccatcaggactcaatgctccccagaaattggaccacagctttccatgacgagttacaagaggagcaatgatctttctgttttgttcaatcaaaattttt

SEQ ID NO: 1250 - DNA, 567 bp, Homo sapiens
ctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaactaaaaa

SEQ ID NO: 1251 - DNA, 655 bp, Homo sapiens
  misc_feature 161, 175, 193, 200, 211, 212, 223, 228, 324, 396, 518, 546,559, 565, 571, 584, 597, 601, 610, 613, 622, 639: n = A,T,C or G
gaaagaaaccaatttaatgccaccaaacataagcctgctatacctgggaaacaaaaaatctcacacctaaattctagcagagtaaacgattccaactagaatgtactgtatatccatatggcacatttatgactttgtaatatgtaattcataatacaggnttaaggtgtgtggnatggagctaggaaaaccnaaggagnaggaaattatnnaaaagaactgnaggtnaagtataaagtcatatgcctgatttcctcaaaccttttggttttcctcatggcttctggctttatatttttatcacaaaccaagatctaacagggntctttctagaggattattagataagtaacacttgatcattaagcacggatcatgccactcattcatgggtgntctatgttccatgaactctaatagcccaacttatacatggcactccaaggggatgcttcagccagaaagtaaagggctgaaaaagtagaacaatacaaaagccctcgtgtggggggaactgngggctcactcttacttggccttcattcnaaacaggttgggnctttcntgcgangatctctcagggnggtaaaaactttntggntttcaacanaanaggtttggntgaatgattactcggcngacacctaagggatcc

SEQ ID NO: 1252 - DNA, 672 bp, Homo sapiens
  misc_feature 4, 653: n = A,T,C or G
aaantgcaaaaacccagaagaccaataattctgaaacttggcatgagtgtgcccagtcagcagcttgcaaagagaggatgtgtcagttactacaattgctgtactcctttagctgagtccttcaactttctccttcttgccagtaaatactacgttgtaattcatatgactgagatcttagtatcacaggatttttagctcccatgcctccttcaaaattgtttacatggatttgtttctattctctgtaggccatattccaaacacattcacttctaaatccaacacaagtgaaggaccagccaggatgaaacacttcagcaatcattttgttaaaaataacatcctggtcatcaagctaagcataagcacctcttgtataacaattcatcttaaaagcttaaagtacaataataaaaataactgcctgaaaactggaaatgaaatacaacagaaaaactgaagcattagtaatttttgcaagtaacccaggtacagtacatttgatttcatagagggtgttttctgatgtttaaggagagggtagaaggggtaggaaaacttggcaaggaagatggaaacagcacaaccagttattttgcttttaataaagtaaatgtaatgacaggagtagggaggtgacaaacacatcnatatatatttttcttatgg

SEQ ID NO: 1253 - DNA, 644 bp, Homo sapiens
  misc_feature 578, 582: n = A,T,C or G
ccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaatatggggtgaagatctaagacatttaatagtatcgagaagtacacagacaccactaataatcagacctgattctggaaaccctcttgacactgtgttaaaggttttggagattttaggtaagaagtttcctgttactgagaactcaaagggttacaagttgctgcccaccttatcttagagttattcaaggggatggagtagatattaataccttacaaagagattgnaganggcatgaaacaaaaaatgyggactattgaaaatattgccttcgttctggcggaggtttgctc

SEQ ID NO: 1254 - DNA, 438 bp, Homo sapiens
aaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccatttt

SEQ ID NO: 1255 - DNA, 519 bp, Homo sapiens
caagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagcatcttctgagactcacaggagaatatggaatgtgatctacccaatcacagtcagtgtgattattttattccaaatatctaccaaggaatgaccaggagaataagatcctccgatgttcgcaatggtgtggtgtcaggaggctgcctcttagacaatctccagatgtactgtgatgtgagtttgaaaaagagttcctgaagtaccacatctgggagacatgccactagctgagcttcccaaaagtctaccaagagctgaggaattgtatcttcatccttagcacaaagcaccttaaaaacagtaaaaggagcctctatattccagataaatatagcactgataaagcgacag

SEQ ID NO: 1256 - DNA, 178 bp, Homo sapiens
ccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaagg

SEQ ID NO: 1257 - DNA, 255 bp, Homo sapiens
gggtccacttgctgccccatcattgtatcaccttccttcaatcttttggctgccactctcatgtagggatccacggtgaggaacaaagcttcaagcaggacctctccattttttaagggtgggagctcagatgtcttcaactcaaagtcactattagtaggatagccaacaaagtgcttcttcagggtccatgtcttagtacgaaccatcctgaagctcaggagcccgaaggttccactgcctggggaaggcggc

SEQ ID NO: 1258 - DNA, 630 bp, Homo sapiens
aaaactaaaagcatcactgctgaactccagctcagtcttcccattttataatgaggactctgaagtttatagaggtcaaggacttgtccaaagctttagatatgtagtgtctgtgcccttttcctctaagtttctcctagagaatgtgggggctcaggaacagagaaaataaggtgcaaaaagtagaaatgggtggtgtttctcaaagtgtggtccatctgcatcctagtgactggggtgcttgttaaaatgcagattgctgggccttatcccaatctgaccaaatcatctcaggatctaccttttgaacaaacttgcctaggtcaaattcactcttgtggaagtttaagtacttcagaaacaagacagccacagaaggtgcacctgctaatttggtggcttccagtgcctcatctgtaacttctggtgaaatcctgagatgtcttactttacattgtttacatcccataacattccaacatttagaaattcactcgagcttatttttcttacttgtttagcactaaatgaaaatagctccctgaagttaaggagtttatatacagtaattcatgcaagtgtgtaaattaaacagatgactttcccccctaatatctaatgcacagcaag

SEQ ID NO: 1259 - DNA, 159 bp, Homo sapiens; identical to SEQ ID NO: 235

SEQ ID NO: 1260 - DNA, 115 bp, Homo sapiens
aaaaatactataatttcaaaacttccaaatttcaacagatgccagtgttctctccttttttcatatgggaaaatttctttcaaaattatttgacgcttggacaaaaattccacag

SEQ ID NO: 1261 - DNA, 280 bp, Homo sapiens
aaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcctcaaaatgtttatacgtggaaacacacctacatgaaaagcagaaatcggttgctgttttgcttctttttccctcttatttttgtattgtggtcatttcctatgcaaataatggagcaaacag

SEQ ID NO: 1262 - DNA, 144 bp, Homo sapiens
aaattatttgatgagttccacttgtatcatggcctacccgaggagaagaggagtttgttaactgggcctatgtagtagcctcatttaccatcgwttgtattactgaccacatatgcttgtcactgggaaagaagcctgtttcag

SEQ ID NO: 1263 - DNA, 487 bp, Homo sapiens
aaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcacttttt

SEQ ID NO: 1264 - DNA, 250 bp, Homo sapiens
ctgcttcaacagagtggcagcaaccaagctggagtccaagccccctgataaaaggcagccaatccttctgtctgtcatcaaacgtttctttacagcattattaaaaaggatcctgaggttgttcttcacagtttctatctcaaaacctggaaagagtttctccacattgtcatagagggcgtgcaggggttcatcccgacagtgatgatatttaaccatttccacggatgcaactttgccatttggcttt

SEQ ID NO: 1265 - DNA, 394 bp, Homo sapiens
aaatatttgttccaacctttttcgttggtggcatttatggctttggagcactgtcaggcccatgttcattaccgtgagctcctgtgcatctcctaatttccaaactagcctggaaaacgcctccattgaccatgattggttcatggtcctgtgcatggaacatcatatgttcagggagataaagaactctgatagtggcacctgggtaaaaagtacaatccattatatctggatatcaagatcttttgcagttgaagagaggtattgccacagagaaaattataggagcagaagaaagtcaatgaaagtcaatgatgacactccattaggaaccagaaagatggtatttatttatacatataataggtgtaagagattagaggaagcctgtcac

SEQ ID NO: 1266 - DNA, 229 bp, Homo sapiens
ccacagttgtatcatatagcatctctaacatttcatctaggattatctagtatagatcttactatatttggggctatgttgtatacaatgttaacaagaacatatcttctctgcatatatgtgtgaattataaagaaaagcatgagaatgactctaagttcaacaaacatgggtgaatctctatgtgctcccagtgtcctggatgggctccccagcaagccattcctcc

SEQ ID NO: 1267 - DNA, 722 bp, Homo sapiens
  misc_feature 658: n = A,T,C or G
aaatcttatcaactttccaaattttcatactaaaatatattattgtattaatacaaactacagtattatacactacactgtgtaataaataaagaaatataaaaataagacacataaatataaaagttttctaaaactaaaagtacatatgtcagtaagaagggtattaatactgccaggtttgaagacatacagtacaaaaatgttgcacagatctataaactaaaagaaataaaataatactgataggtaaaaatcagctaatgttgttaataaattgggtccataataactaacatttggaaacagttatgagccaaataacaatagcatgtccatgtctgaaatgcaagtacatggataaagcagattagaaaatttccctttcgtttctgtagagaaattctgaaaatcaatcaacataaaatcaataccgaggaattgaaggatgaaatgtcccagtgtttcagtttctctgacagagtcagtggttttaagttttatttgggaattttgatacaagagacaaatcaacaaatgctagttattgtaggccacacattggatgaaggcgggttagagccttgaaaatactgagaaatggcacttacagcacacaggtcttgcttaagggcaaaggagatacaaagcttcatgncatatccttcatatggtaccacatattcaaacaccatcccaacactgatctgatgattttgctg

SEQ ID NO: 1268 - DNA, 407 bp, Homo sapiens
gatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggtttttgtttcttttgggtatttcttttttggcacatgtgaatcttgttttgtgtaaaatgaaattactttctcttgttctctgatgatgggttt

SEQ ID NO: 1269 - DNA, 675 bp, Homo sapiens
  misc_feature 613, 629, 643: n = A,T,C or G
ctgaaaaagagtgatcctcaatatcctaactaactggtcctcaactcaagcagagtttcttcactctggcactgtgatcatgaaacttagtagaggggattgtgtgtattttatacaaatttaatacaatgtcttacattgataaaattcttaaagagcaaaactgcattttatttctgcatccacattccaatcatattagaactaagatatttatctatgaagatataaatggtgcagagagactttcatctgtggattgcgttgtttcttagggttcctagcactgatgcctgcacaagcatgtgatatgtgaaataaaatggattcttctatagctaaatgagttccctctggggagagttctggtactgcaatcacaatgccagatggtgtttatgggctatttgtgtaagtaagtggtaagatgctatgaagtaagtgtgtttgttttcatcttatggaaactcttgatgcatgtgcttttgtatggaataaattttggtgcaatatgatgtcattcaactttgcattgaattgaaattttgggtggatttatatgtattataccctgtcacgcttctagttgcttcaaccatttataccattttgnacatatttttacttgnaaatatttacctgncccggccggccgtcgaaagggcgaaattcaac

SEQ ID NO: 1270 - DNA, 268 bp, Homo sapiens
ccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactgg

SEQ ID NO: 1271 - DNA, 307 bp, Homo sapiens
cctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggagg

SEQ ID NO: 1272 - DNA, 798 bp, Homo sapiens
  misc_feature 613, 619, 703, 726, 773: n = A,T,C or G
ccattgctagaaattgaatcacaaataatagctaataatttttcatttttcaaaaaagatcatttggatagcagctatgtataaaatggaaaataaaaaattattctattttgcatgaatagttcagactttcccataccacagccaagcagtaactaaaattaggatcttaattttcaatgataaaaggtctaaggttcatttaattatgctcctttaacactgtctttctagatttttcacccagtattttcaaaatttgggaatgtaaacaattgatatatttattgtatgttggctagcagttcatccttctgcaaaatatgcattcagagaaatgtgaagcttgttttaatgaagacttaaaccatttgtgtcatttgtgttttcatattcaaatacaccaaattaaaattctgaacctatatttttcatcattaacttcctaatataccagaacatatacctttttcatgtaaagttggcaatgggatatggcagttttatttttgaaaaatatgtaacatgactttaatatttttatagttttcagaattagaaacataggaagggaaaatgttttaattagataagtcaactttttatgggctgnagtggngactataatagcaaattataaagcattattaaatggttataataattttaatattacctcattatgaattaactaaaataaagnggagtgatatttttaatgggtgntcatactggagctcctgagatatatgatttgctattgactcactggntgattgaataatatattactcgcgg

SEQ ID NO: 1273 - DNA, 664 bp, Homo sapiens
  misc_feature 623: n = A,T,C or G
aaaatataccttttcacaggtagcaagaaatagtacatgtaataagtctttatgactggaatgatccagaaatatcacaaagcatgagtaaacacatatataaaagtagctcatcatttccaaaagttaacctttagcctttgtgtaaaataaatggtgccaacaatctttataatgtagcaagctttccctgtttaatatccaaaaaatggagggtggggaggttgaagaaaaataagaaaagttagcaaataagatagtgaaaagaccaatgcagagaaaagtttatgtaatcaaatcttgctttgtctccacattatcacattttaagtggataaatttatgtaaacagaaaaagatgtccacaaaaccatatctatagatgtcatttggaagcatcaagaaattgataagtatgtggtgaattaaaattacttttataatgttttgctttcattaatgtttgttattgcaaaaatgtaagatttcctacaattttgtcttcaaatcccaatctagcccttcaaacttttatccaggttctccagaatatttggagtctttgttatcaaagcacaaggaaagctggcattcattatcagacttcgctgctttacaatganttcaaatcatttcatgatacaaataaagtgcctctgactgg

SEQ ID NO: 1274 - DNA, 153 bp, Homo sapiens; identical to SEQ ID NO: 239

SEQ ID NO: 1275 - DNA, 504 bp, Homo sapiens
aaaattctgataaaaatttactcaattacattttatacattaatatttagtgaatttgtccaaaaaggctatgtttaatttatgtgtaaaaataacaaaagatgtatcagtcagtctctgggcaataagaaaggaagaaagccttgctagaaataataaataatctcacgcaaaaggccaggtgacataagaatactacaataatcaatatgttttctttgtatttacaataaaatccatctgttaacactgtgatagaaaaaataatcagtccacatcatgtaataaaaacaggctttgaggatgattatacctcttataataaaaacatacaaggatttctcacagctaaagtacttttcaactttgacaactaatgacagtcatgggtgaaggtaaaactgacagagtactttagatcagctatgtcctacagtcaaggaatcaagggcattacccatttaccaagcagcaaaaagcactttcatttttccagaactattt

SEQ ID NO: 1276 - DNA, 533 bp, Homo sapiens
gacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaattt

SEQ ID NO: 1277 - DNA, 78 bp, Homo sapiens
ccacaggaagttgcaaaaattagatggactctgtgtagctagccactcttgagtgtcaggtctgcatatgtgagtttt

SEQ ID NO: 1278 - DNA, 560 bp, Homo sapiens
aaatatctaaaacaatggcccactgaagaaaggaacaattaactctttaattaattccttaggataagtacccagaaatttaacagctagggcagacttctaatacaataccgaaagtccttccaaaaaccaagtggttgccaacttatgtcccttagcattataacattcttgagccaatagtgtaaaaatacgctgacaattttataggcaaacattactcaaggtatcttactttccacttattactaaagtaattaacccctaaatagatgctcctcaacagtgggactacatcctggtaaacctatcataagttgaaactatcaagttgaaatgcatttagtacccggataaacctatcataaagttgaaaatttgtaaattgaaccagtgtaaatcagaggccatcttacttcatactcatgaagcaactatagtgggatatttttcaacttacgagatagcctaggcttgttgaaacactgtcctaatttactggctctctggtaattaagtcataaatggtcaaacatcaaattctagaaaagcatatattt

SEQ ID NO: 1279 - DNA, 580 bp, Homo sapiens
aaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacatttt

SEQ ID NO: 1280 - DNA, 307 bp, Homo sapiens
aaacacatacgaagaaatcaactgtgattatgaagtggcagccagctaaatatgtcttgtatttgctctcttcctttttttgcctaactcatcctttacttccattcctgcttccatggtaatgcaggctcaaataaattactaggatacaagattacttcaagcctcttttctgtggaactcataatatgataagcatttgttacaagattgcctgtagttgtttaggggataaattatattagggaaagaaagtctttctttagttggttaaattttctattataattgggtactaaatttattt

SEQ ID NO: 1281 - DNA, 235 bp, Homo sapiens
aaaatattttaatagttacatagcactttagtttgctgatttaatttatcccaagggacaaggatgttaatgagaaaactgactagatttcagatcacagattttaagagaacaaggatctcaaaaccaaataccctctgcttaaagtgttttttgtgtttttcactactgaaaatgtttagagattgacttacctattgctgatactcaaaacatctgatatcttaatattttt

SEQ ID NO: 1282 - DNA, 230 bp, Homo sapiens
  misc_feature 194: n = A,T,C or G
aaagaatttctttataagattkactgtmtaagattaatagcattcgaagatccccagacttcatagaatactcagggaaagcatttacctcsgtcgctgaccackctargggcsawggccagcacactggcggccgttactagtggatccgagctcggtaccaagcttggcgtaatcatggtcatagctgattnctgtgaggtaccagattgcctgtagttgtttagggg

SEQ ID NO: 1283 - DNA, 638 bp, Homo sapiens
aaacacaacagctataaacctgaacacatatgctatcatcatgccataagactaaaacaattatatttagcgacaagtagaaaggattaaatagtcaaatacaagaatgaaaaacgcagtacatagtgtcgcgaactcaaatcggcatttagatagatccagtggtttaaacggcacgtttttgcttataaaaaaagtgcaaaaaagatgtggtttacaagttaaagctacagaatccctttttgctgtaattgcaccagttttaaagcctctggacagagcagtatttcgtttaaaactttgttyttcttaaaagcttacagtgtttggctaattctcctcycctttttacaagacgggggccggagggtggacactggtggcaggttaagggatactgtcactttaagaagcctgcagattgaagtgtaaacatggagaaattaggggctgattttttaaactgtgtgagatattaaccagccgccctgttataaaatcaggaaatccaaacagcgatttacaccgattaacaccccctttatatattttttacaaaaatacactgagaaaataatcaaacgttttcatctctcttgtctttttttgttttttaaaagtgtcaaaagtctacattt

SEQ ID NO: 1284 - DNA, 745 bp, Homo sapiens
  misc_feature 715: n = A,T,C or G
cgacggtatcgataagcttgatatcgaattcctgcagcccgggggatccactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaanggggttaaactttaaaaaaaaaaaaaaaaa

SEQ ID NO: 1285 - DNA, 190 bp, Homo sapiens
cgacggtatcgataagcttgatatcgaattcctgcagcccgggggatccactagttattaatagtaatcaattacggggtcattagttcatagcccatatatggagttccgcgttacataacttacggtaaatggccgccaccgcggtggagctccagcttttgttccctttagtgagggttaattgcgc

SEQ ID NO: 1286 - DNA, 153 bp, Homo sapiens
ctgcatctttctacaattctaccagcaatatatgagggttacaatttctcyccatctttgtgaacgcttgttagagtctgtcctcttttcttccattctgtgggttggctttttactttctaaatggtagaaccttcaaagcacaaaggtttt

SEQ ID NO: 1287 - DNA, 232 bp, Homo sapiens
aaaaacacaaaacactagaacagttgctatgaaattactgataatgatccctttaataaactgcaattaaccactaatatagaaattcaatttaagcaagaagttttatatattatactttacagaaaaaaataattttgaaaaagtaatgmcaaacagagatcaaacatttagggcattagttactgcattctctttttagaatatacattaagtaacactagtaaaattt

SEQ ID NO: 1288 - DNA, 90 bp, Homo sapiens
aaacttagtgactatttagttcaattgytcatccattttttatttgcttttataattgcctccttgttttggtatattgtaaaataattt

SEQ ID NO: 1289 - DNA, 670 bp, Homo sapiens
aaatcacaaagtaaggcaccattggattaaacatttctcctggcttttactaagtaaaatgcatagtgaaataaatactgaacactgagttttaatactgtaatacatttcaatataaaataagaggtgaatgttaaaatactgtattacatgttgaatacatttatctgaaaatgttataaaaaaacacacatgtaagctctgatttcagggaagaaaaattcatttttgtaattttccatagtttaagattttaccacagaacttattcatagttttagatgcaattaggttgcaaactttcaaagaaagggtgtaggtgtattaatgaaacagtcacttaaacactacattctaaaacaatctattctggatgaatggcaactttgagctatcaccctgtttcagatttagaacggtacctgccaagttcagatatgcaaaggaattgtccaattcttactaccccttataaaattcagactcactttctctgagtcagacttttctccgtcatattttctaggaagggcaaattccatcttttgtgaaatgggtcattaggctttatcatagggatgtttttcactgttgaaatcagataaaagaatcccaaataaatgatgctgctaaattaccaaactgctagagattaaaaaaattttttttt

SEQ ID NO: 1290 - DNA, 352 bp, Homo sapiens
aaacaatgctacacccatttttggcaaagtgctgtattgttcagtctgtgtacaaaactgaccatctatgaaccaatcagtataaaaaatttctataaaaacaaaatttagacagtggctcaagaaaacaagctgccatttatgcatagattgatgtacagtaacctaaccaaatgtcccttttgaattttcaagttactgaaaaaaaatgtgtcgagaaacacattaagaaggcacatgtacagtctacaatactcttcagtctccctaactcatgccctgcccctataaaggaaatatgttcacaattttacttgagaaaaaaaaacaaagccacttaaaaaaaaaaaaa

SEQ ID NO: 1291 - DNA, 99 bp, Homo sapiens
aaaaattatttaaggtaatggtgttacgaatggtttaaaaatgtctggtgacttgcttatttttaagtgatcaccattaagtcagaaaaatgtattttt

SEQ ID NO: 1292 - DNA, 295 bp, Homo sapiens
aaatatacctttatttctcaaactcaaagctttatcaagttctaacacattttgcattgacaagtgattttatctgcatcaagtaaggttagtgaccaccacgaaagaggaatccccagacctcctaggcactaagaaatatttcaaaggctatgcaaatatagaacaaaaagctttcaatttagtctaattggtatctatttttcatctatattaatttggaaataagttgctaccttagaaaaattacatttttatccattaaaataaaacaccagataggttgagttttttt

SEQ ID NO: 1293 - DNA, 256 bp, Homo sapiens
agattcacttcaaagtgaaaatgacaacacatctcaagaaactcaaagaatcatactgtcaaagacagggtgttccaatgaattcactcaggtttctctttgagggtcagagaattgctgataatcatactccaaaggaactgggaatggaggaagaagatgtgattgaagtttatcaggaacaaacggggggtcattcaacagtttagatgttctttttattttttttcttttccctcaatccttttttattttt

SEQ ID NO: 1294 - DNA, 90 bp, Homo sapiens
aaaatacttagctttattaaagacatggtactaaaaataacagattccaacatttgctctatttctacttatatatcataaataagacag

SEQ ID NO: 1295 - DNA, 519 bp, Homo sapiens
ctgtcgctttatcagtgctatatttatctggaatatagaggctccttttactgtttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatcttattctcctggtcattccttggtagatatttggaataaaataatcacactgactgtgattgggtagatcacattccatattctcctgtgagtctcagaagatgcttcattttgtagaacggtgtaagtggtttccattccagcatgaatgtggtcggtcacatggcagtggagtaaccaaattccaggtgttcttggaaacatttctagggtttggtatgttccagggaaaatgtcaaagacatcagaactataaactcccctgtgcttg

SEQ ID NO: 1296 - DNA, 419 bp, Homo sapiens
aaagcaaacagcagaaaccagaagcttctgaccctctaacatgtattactgtccaacccaccatgagaagtatgttcacttggtgacaacaaagagactccgtatcatatgtatgttaatgaccagattgttcatatgggatttttcttaacagattatcaggttgagaatgattctttttctccaagggcaagaaaaagctggctaaatgctagttaattaaatccattctcaattttgaactgtagagaagaacctgacttgaatgagattttctaaaggaagacatttcttgctcaacctcaggtataattagattataaggaatctcacgtccagaattttatctgctgattgttagtatggtaggtaattggccttaggacactatttctactagaaccctttacattattttt

SEQ ID NO: 1297 - DNA, 199 bp, Homo sapiens
caggtctgaagattttacatgcagataccagataccttaacttgtatttctttagtcatcttttggcttggaagtttcctctgttgtctttgctgaatccttcgctttacctccattcttaggtgctttggagctggaagcagccttcttgcacttatcctttgctgtgttctgtgaggtttctgtagtggagggacag

SEQ ID NO: 1298 - DNA, 484 bp, Homo sapiens
  misc_feature 437, 456, 467: n = A,T,C or G
aaatacacttgaaaagtaaaatgtttttctagcttttccctcagggcgtaacaccacaccattcataacaatgctattttccaaaggtttcaattagatttcctcagaagcatacctgaactgttaatcattacaactcctttgtgaaacatgggactggttgattacccagtgtaatcactggctgaaacctcagcacactgtttttcaccccagtggaggcaggttttcacctcccctctagctgtacccctctcttaatgcccatattagagaactgtgatcttctttctccactagaaatgttcactttcatcaggtaagggataaaacaaaaacaagagacagaagatcttaaaaaaaaaaatagtaatagggcaagtaaactcagtgaggttagaggaatttgtttggggggcattctatgttgttagytncatatcatgttcagtttgntggttctaganccctctgaaatgcatta

SEQ ID NO: 1299 - DNA, 419 bp, Homo sapiens
aaagtccatctttgcaaattatacgttgctataaatacattgtgtatttggcattatgtgaatttgtttaatccagtgtcaattgtctaatggtctaaagtgtcccattgaagttataatctggatgaactgaacaataagagaagttttcttcattagcccaattgtttatcactcaattcctactcctgcccatggtttcttccaccttcctctggagaacataaagagattctagatctctgtataaggtggtttgctttagcttgaaatcatcagtgaggattatacatgggcaatgtccagaaatcacattattgctcatagaccgtgtagtcttgatctaacggataactgtacattgtcttcactaagaagctagggtggttgtccttgatattgggacattgtagacttgg

SEQ ID NO: 1300 - DNA, 182 bp, Homo sapiens
  misc_feature 3, 5: n = A,T,C or G
ccntngaattgtgtgcatagggaagcactcacccaatgagactttctccaatgtggactctgtgtgtcagggaatgaatgtagaaaaattcactttggagggttatcakctcaactagtaagaagcattaatattattaaagtgaagaaactgcagagaaaattacagaacaaaactgtagg

SEQ ID NO: 1301 - DNA, 312 bp, Homo sapiens
aaagtttttatctctgctgaggcttcacatctgtttgctcaattttatttttatttcaatccttgagcatgtttataatatagtagtatccccttattgtggctttactttcctcactttcagtcacccacagtcaaaaaatatgaaatataaaactccagaagtaaacagtttataaattttaagtcacactttgttctgaggaatgtgatgcaacctcccgccattctgctgtatccagttcaggatgtgacatacccctttgctcagcagatacacaattcctgcttcctgctcattagacatttgcag

SEQ ID NO: 1302 - DNA, 109 bp, Homo sapiens
attcttagattatatgtgtccatctttgcagctttctgagagtaattttatttgttgtcttctgaaatgtacatgtatacatgtacctactgagtgctatgtgattttt

SEQ ID NO: 1303 - DNA, 330 bp, Homo sapiens
ccagagttacttggatcagcatttaggaaagtaaaatatagtggaagtaaaactgactcatccaactagacattctacagaaagaaaaatgcattattgacgaactggctacagtaccatgcctctcagccagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacattttt

SEQ ID NO: 1304 - DNA, 170 bp, Homo sapiens
ccactgtagtctgcatatccctgtccatatccatagttcccatagttatacccagtataatcatatccgccatagccactatagttttgatcaccaccataggcactattgtaatttccatatccttgatcataatagttattaaatccttggttccagttttggccctg

SEQ ID NO: 1305 - DNA, 468 bp, Homo sapiens
aaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcag

SEQ ID NO: 1306 - DNA, 326 bp, Homo sapiens
tggtaaagaactacctgttaatgcacaaaactatgtgcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagytgtttccagtcttttcagatggatgcctactgtggagattaactttggcatattccagtgtcagctttctttagctggaattg

SEQ ID NO: 1307 - DNA, 614 bp, Homo sapiens
  misc_feature 294, 442, 458, 465, 580, 592, 609: n = A,T,C or G
aaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtacttcagactttttaattttatatatatatacattttttttccttctgcaatacatttgaaaacttgtttgggagactctgcattttttattgcggnttttttgttattgttggtttatacaagcatgcgttgcacttcttttttgggagatgcgygtytgytgatgttctatgttttgttttgagtgtaggctgactgttttataatttggggagttctgcatttgatccgcatcccctgtggnttctaaaggggatggncctcagnaactgttgcatggatcctgtgtttgcaactggggaggacagaaactgggggtgatagccagtcctgccttaagaacatttgatgcaaagaatgggaccctgccccggggccgggncccctccgaaangggggggaaaatcccangcacc

SEQ ID NO: 1308 - DNA, 304 bp, Homo sapiens
ctgtcttttggaggacgtacgtaataaggttttaatttagtaaaccaatcctatgcatagtttcagcactagccaaacctcaccaactcctagttctagaaaaacaggcacttggcagccttgtgatgtcatacagagaagtcacaggcagtacctgagggtctgtaggttgcacactttggtaccagataactttttttttctttataagaaagcctgagtactccacactgcacaataactcctcccagggttttaactttgttttattttcaaaaccaggtccaatgagctttctgagcag

SEQ ID NO: 1309 - DNA, 289 bp, Homo sapiens
gggatttccaattaacagtattaccagataaatattcttggtccaagcagaaaatatcaacaaaaagagccttcttctcctgtaaatcttaaatgcctacatcactctttatgatacatggatcatcttatgtggatacttaaatttttcatgtctgcttcttttgcctctcccaactatactatgaggaaattcggaacaaagacatttttgtaatatttcttatctccttcacacctagtatagagctgattttacaaaggcatttaagagatatttgaattgattt

SEQ ID NO: 1310 - DNA, 534 bp, Homo sapiens
  misc_feature 480, 490: n = A,T,C or G
tgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagytttgacacctagattatagtcttagtaatagcatccactggaaaaggtgaaaatgttttattcagcatttaacttacatttgtactttagagtatttttgtataaaatccatagatttattttacatttagagtatttacactattgataaagtttgtaaataattttctaagacagnttttatatangctacagggtgccctgattttcttattgaatttggttagactag

SEQ ID NO: 1311 - DNA, 114 bp, Homo sapiens
aaaatttgtaggagttgtagactacctaaatttttaagttatggyatttggtcataggttgactgggtaggtaaagaaggaaacagacaagaaaatggcttcttgaggtggcag

SEQ ID NO: 1312 - DNA, 95 bp, Homo sapiens
gggcgggtaaaggtaggccgcgagagcgaggttaggagaggataggaggccgcagtactgctcacacgctccgctcttctcccactctcgactct

SEQ ID NO: 1313 - DNA, 519 bp, Homo sapiens
aaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatgggctgaatacttttttttt

SEQ ID NO: 1314 - DNA, 518 bp, Homo sapiens
  misc_feature 247, 270, 329, 357, 419, 440, 498: n = A,T,C or G
ccatggtgggtgaagacgctgatctgccctgtcacctggggttttttatgagtgcagagaccagggagctgaggaaacccgagytccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagnacttgtgttatttccaagatggngacttctacgaaaaagccctggtggagctgaaggttgcaggtgagcctccaggttttgntctgagaacacttctctgtaggatctanagcagatgcagagtccctcttccaaaagtactgcagacactcctggctgctcactagcaatngtctgcactgcctcccaactnagcttctctgcaacccttaagaaagacacattctttctttagaaagaattcctgctgnaccttacatgccgaagtaaa

SEQ ID NO: 1315 - DNA, 360 bp, Homo sapiens
tctgtgcatccaatttattatagwtttgtaagtaacaatatgtaatcaaacttctaggtgacttgagagtggaacctcctatatcattatttagcaccgtttgtgacagtaaccatttcagtgtattgtttattataccacttatatcaacttatttttcaccagkataawatcttratttytacgacctatcattctgaatcaagmacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactattt

SEQ ID NO: 1316 - DNA, 277 bp, Homo sapiens
aaaaaacacgtttgttattaccaaawagagacggctttaggtaaaaataataaaaaccctttgcttgyattacytatgcaratagttstatttatctggwcwacgggytaaaggyacagyactataggwctctggcttgagtmtttacgttcatttcttattgctggaatktcatatttcttcttgttggatgactaaaccggatgatggtagagatggtaagccggcatttactcagccccgccctgctcagcctcgggagcggacgaattctcag

SEQ ID NO: 1317 - DNA, 716 bp, Homo sapiens
aaaatgttctcttgagactagtaggcatagaagaaagcagaaggaaaataaatagaaagaaggtcttctaccttcatggctattcaggctcaggagggtggagagaaaaagaaggaggacaaatgaacaagacagatgagggagacatcctctctgatataagatacagtcctctctggtggatggagtccaatttgtgtaacttcctatgtattttcctagataggaccaccactatttgagaaaatatctcactggtaacctaaagccaaggataataaaccttgatatacttaacattcaatttctttccagcaatgtgataaataaatctatcttgtgtttctcttgcagattgtaaaagcattagaacatttacatagtaagctgtctgtcattcacagaggtaagcatccatgagctgccttggctgttcctttgataaagttcatctctttcacctggagtccgtctctacccccagtcccccatgggtggaagtagaattgactcaggcaagagaactaaggggctttcctttgagattggatagcaaaccatataagtagtattccttatcatggctgaggacataagaagaagacgtgatctttgtcttacatccaaattgaatataaacacttggtagcaagcagagctatgagatcatatcattgagaattttagagaatatgataaaaattgatcttgtctgg

SEQ ID NO: 1318 - DNA, 515 bp, Homo sapiens
aaagctgtatcatgttgagtaaacctgacctgagccagcggtttaaggcgattttgctcgatgaaggtcaagacgtgaacccggtcattgccgacttggtaaggatacagcgcatctgcaaagtaaccgtcggcgaccctcaccagcagatttaccgtttccgtggtgccgaagacgctctcaacagcgattggatggccgatgcagagcgtcactacctgacccagagctttcgcttcggtccagcagtcgcgcatgtggctaacatcatacttttttacaagggtgaaactcgaaagctgcaagggttaggccccaaaacccaggttaaacgtgcgcttcctgaagacctaccgcatcgcacatacatccatcgcacggttaccggcgtcatagagaacgcgcttagcttggtagcgagcaatccaaagatctattgggtaggtggcatcgacagttattcattgcgcgacctggaagacttgtatctgttcagccgcaaccaaaaccaagcc

SEQ ID NO: 1319 - DNA, 141 bp, Homo sapiens
aaatttagtgtctcatttggaaataaactctgggcctattagttgttgagtattttttttttttactacctaaaaaaagatttgttaagagctgaattacaacttagcattacataatataaaacactgtaatgtgtattt

SEQ ID NO: 1320 - DNA, 497 bp, Homo sapiens
aaattcagtcctaagaaagaggagtgcttgtcccctaagggtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttccttt

SEQ ID NO: 1321 - DNA, 344 bp, Homo sapiens; identical to SEQ ID NO: 1148

SEQ ID NO: 1322 - DNA, 110 bp, Homo sapiens
ccaccacatagccagccaggaatcccttgaggaacggggaggacaacagcgagccaccctggcccactccactgttgacttcgtcttctacacgccgctgcaggctttcc

SEQ ID NO: 1323 - DNA, 359 bp, Homo sapiens
ccacgctgctggcctgggctggcgtctcctgctgtgagctggctgaggaggacttcctggcggtctcccccttagatccgcgctatcgtgaggtccactatgtcctgctggatccttcctgcagtggctcgggtgagatggtgagaaggcgtggctgagggactcagaggtccacagcagcttagacctggagtcatctgttttggtcttagttctgacactttaatgggcttgggaccctggagcaaaagttctcctctgtgaagcgaggatttcaggagcgaggatttcaggactgaggcagcctgtgaagctgtgtaaccgagacacgcttttccttaggtatgccgagcagacag

SEQ ID NO: 1324 - DNA, 258 bp, Homo sapiens
caatcacacaaccacaaaaaagatactgtgtgctctcactttccaaaattctgcctggtctmctcctgaggaaagyagtgatatggtagctggtgtggatcccctaaaggaattataagatggartgygargaacattatcttagactataakactgkctgcatrcrgatatgktstcraagattattcctgctgcraataaagakmttgskaaagagcartatasagctatcacagtctattgacccamasatgttt

SEQ ID NO: 1325 - DNA, 534 bp, Homo sapiens
ctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcag

SEQ ID NO: 1326 - DNA, 177 bp, Homo sapiens
ctgcattatgtgtgtttagaacgagaagttgtttgtacagtatttttctattgaccgcttccgtcttgcctgaaacctgggcattctttccaatagacagaaaatcagagagtcaaatctgatgcgcaatgagttgttctgagaccagtaatccacggtgctgcaatttgggttttt

SEQ ID NO: 1327 - DNA, 266 bp, Homo sapiens
aaacttgttttatctaatactgagcactgtttttttgtcaagtatttttttaagaccacataattctttttgtctgctcaaggaaaggatagataaataattggcacacatttgtttctcactgaattttacagtagtaaattaatgttataatgtaccacatggagatgagttggtaagaaatcatctagttccagagcccagggattataaacagtaggtgaaatagatttatgacttacgaaatatgttgtgacaatatattt

SEQ ID NO: 1328 - DNA, 409 bp, Homo sapiens
ctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataatcccatagtcaagagcatcacagtctctgcatctggaacttctcctggtctctcag

SEQ ID NO: 1329 - DNA, 136 bp, Homo sapiens
ccattttcgcacagtccaccataaaattgaaaagattgaccagagacagatcatggagggcttggcaatctgtactgatgaagccatggaccagaagagaagtgagtcaatgaagagagtttctcttttcacatgg

SEQ ID NO: 1330 - DNA, 311 bp, Homo sapiens
ctgctaacagccctaacggtgcaacacaagtacaaactcaggaacctcttcgactgccacgcccttcaccaacagaaggaagacagtggcgccaccacaagtggcagggcacaggggcttctgtgacaacaatatgtccttctagtatacattcattgcaaaggctgccctgaagtttcgtttttggaaataactgttatcatacattttgtatgatgttgcttgtgggcaccatgaagagagcctggctgtaaaggacagagggagctaaaccaacaatgcatggccctgcgtgcccacaagagggagcc

SEQ ID NO: 1331 - DNA, 613 bp, Homo sapiens
ctgggccakgagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacaatcaaaaggatcgttttgttttgtttt

SEQ ID NO: 1332 - DNA, 591 bp, Homo sapiens
  misc_feature 10: n = A,T,C or G
ctgagttaanatggtaaagccaatattattttaggaggaaagaggacgaaggccaatgaaccaacatctgcctgctatctggtgcatcacccaaggtgaccaatggctgggcacaaataaacttctcttttgctagccacagagttgctcactgtggcaagcctgagctggtcagaacacctgtgtgtgtgttcctgatacacactaaccacaataagcaagtctgcacacatctctatgagccccatgcaaagacaagacattcccaaagatcagtcactagagtgcaacaacgaaattcaagatttgaccaaaacagaccctgctgcctcctaaattgccaattgcctctcaaaaacttacagaaaaagggacattataagaattcatagagggagagaagaaaaagctgctactcctagtcattagtacaatgtgctgtgttaattagatacctctatataaattagaaaaagtgctttacttgcatgcttcaataaaatgaatactgagtgtcgtagtgttagatctgtacagatataaattttttgcagctatataaaagtgtataagatgggcttttgcatttta

SEQ ID NO: 1333 - DNA, 379 bp, Homo sapiens
ctggtacaaaggcgaaagagtggatggcaacagtctaattgtaggatatgtaataggaactcaacaagctaccccagggcccgcatgcagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggctcagaacacaacctacctgtggtgggtaaatggtcagagcctcccagtcagtcccaggctgcag

SEQ ID NO: 1334 - DNA, 384 bp, Homo sapiens; identical to SEQ ID NO: 251

SEQ ID NO: 1335 - DNA, 555 bp, Homo sapiens
aaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagctgaatgtatatatttctaagaagaatttgtttagcagattacaagttggcaaaatagactgttcacagaaactaggcaaaaattt

SEQ ID NO: 1336 - DNA, 505 bp, Homo sapiens
cctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaargaaaaataaaaagaaaattaagaatgaaaatactgaaggaagccctcaagaagatggtgtggaactagaagg

SEQ ID NO: 1337 - DNA, 385 bp, Homo sapiens
ctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttattttt

SEQ ID NO: 1338 - DNA, 350 bp, Homo sapiens
aaaggtgatattacacaaaacctcgtcttttgttcaactttggatccattggcaattcaatggcctcaatctccccaaactcgccaaagtactccctgatcttttcctcagtggcttcaggattcagacccccaacgaagattttcttcaccgggtccttcttcatagccatggcctttttagggtcaatgacacggccatccagcctgtgctccttctggtctaggaccttctccacactggctgcatctttgaacaggataaacccaaaccctcttgaccgtccagtgttgggatccatttttattgtacagtcaacgacctctccaaatttagtaaaatagtctttt

SEQ ID NO: 1339 - DNA, 443 bp, Homo sapiens
ctgctcctctagtaataagttcctggggataatacattaaccaacattggttgaaacatacctgagtaatcatatcaggatgcatgttaagctgataaaacaataagatcccaaaatgcagtagctcaaaaaaagtagaagttaatttatctcctgggggacagctctggttctcaaattttacaggctcagaatcacctgcagggcttgtgaaagtacagattgctgcgctccgcccccagagtttctgatttagtaggtgttaggctgaaccaagaatttgcctttctaacaagctcccaagtgatgctgatgacttgtaggaatggatttacttctaggattagacttcagctcactctgtttgctgaactctttctaatatttcttaagttggtagactcyctgctccaggttctcaacgtgaaggaaggaacccccag

SEQ ID NO: 1340 - DNA, 273 bp, Homo sapiens
cctcaggaacaggtaggggcagcagaatagaatagcatccatttcccagagaaagactgcctttacatktcccatgcttttagcacaaagcagcgtctgggccactgttaccagaggtgagtttatacatttacaaaatgcttaaaatctttgggaagcaagaggaagctaaacagaaggtcccatgttaactgaaggcaaattcactcaacctctctagtaagggacccatgggcctacagagtgttccctctacaatgtgcagagtggaaa

SEQ ID NO: 1341 - DNA, 561 bp, Homo sapiens
ccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacaccgccaagacagcagtcttcytcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgttt

SEQ ID NO: 1342 - DNA, 159 bp, Homo sapiens
aaagatggcaaggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaatttt

SEQ ID NO: 1343 - DNA, 76 bp, Homo sapiens
aaaatgtaaagccaatctatcaccaaaaatggcataaatgtaaacacaagctaattttataatccactgctatttt

SEQ ID NO: 1344 - DNA, 726 bp, Homo sapiens
caaaagcagcctgaatacgcaactcacgccaagagggcagcagctctcctgacatccatgtaagaaggctaacacctaaaccacacgcaggcatcctgaactcagcagctctgatccaaggtactgagtggagacaaagcactcggaggtggcaagatgttcagcaaccaagtaagacacactggcaaggcatcccacccaaaggtgagaagcacaaagcaggcttggagaaacaaacagtcatgccaggtgcagccagacatcctgctataagccctgaccctagtaccccgagttcatcaagtgctctggttttgtgtccataaagcacagagggcactgaccaccccaaaccagaatcccaaggaatccttatggatggcatagggcctcagaactgctgcaggatcattttccttttcaggtcgtggctgaacttgttcatcctgaagagctcactgtcataaaatgcagagaggttgtggatgttgatctgacgagccttatccaccaagtccttmtcagggacctcaatagtgtcctgctgggccccaaagcggttgcgctgatatgtcacstgctctgccactaactgcttcagtatgaagagcaacagctcattgttgtcacgccggaatgaaaggtagcgggcaaaagtcttgcgcatgctgcgcatgacgctgaacttctgtgtgtctatgaagstctccakmatcaygagratgg

SEQ ID NO: 1345 - DNA, 742 bp, Homo sapiens
ccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttccaaaggaagtcccatggatgggtttctagaagtctataaatgctctgaaattgtatttttctgtggaaaagcataacttttatctgcttggtcgtgctcaaaaaaagatcatgaatggaatgaattgcattgaattttatgccattgggggcttaatactaaaaggatatggaag

SEQ ID NO: 1346 - DNA, 573 bp, Homo sapiens
  misc_feature 498, 543: n = A,T,C or G
aaatgcattkttaacttacagtattttcaacttacgatgtgtttatcasgaagtaaccccatcataagcagaggagcatctgtattgcgtaatttgactggcacagtttattaggttctgttcagtgwtttccgtcaacaagatgtttattgtgtgagtaaacaagttaagccctgtgacaagctgaataagaatagtctctcctcagcagcttatagtaaacaagggtagtaatccttacattagtggctagactatcaaacgaaatatataacatgtaagaacactaaagacagaattactgtggcatagagatagttagaattgcttcagcctaagagatgaattaggtaatgcaaggaggtgaatatgttggcctgcaatatgaacaaggcagagagctgggagagtaagatgtaagttgctaaggagggatgtgtcttgagtttggaaaccataaagggaaatcataggtaatgctagagtcactgatcttanggagccttgaataacggtgatgactaagggaatctttattttggngggactattggaattaaattggccagaatt

SEQ ID NO: 1347 - DNA, 333 bp, Homo sapiens
cctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtgg

SEQ ID NO: 1348 - DNA, 185 bp, Homo sapiens
aaaaaagcttgcagcaagaaaatgccagtgtgcaactgggtgactaaagaccaaagaaaaacagttaaaagggacagcttacttgctctctgtctcaggtttaacttctcacctgaaatctctcatagccctaattaaacacaaacaaaagtctcttccatagataggctacttctcagcttcag

SEQ ID NO: 1349 - DNA, 171 bp, Homo sapiens
gcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagagg

SEQ ID NO: 1350 - DNA, 400 bp, Homo sapiens
ttgtcatatcatatctatgtcacctgtgtattctgagattacacacatacctgccaatatacctgggaaaggttattttatcacagttacacttgagttcttggcaggcaggactgaggaagagtaatttgaaagaagttttacatcctatttagaagaaatcactagtatttccttaaataacaggttacaatagaaagatactgcctggaagttatcctttcactttggttcatttttagtttttctttatgatttacatagctgtttaattcatttgcttatagtacaatcctgccataaagtattaaagcacaagatacctattattccttcaacatctgcatttttcaagttttatactctacatccacagtacgtcagcagttcttgaatgttt

SEQ ID NO: 1351 - DNA, 309 bp, Homo sapiens
ccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttgg

SEQ ID NO: 1352 - DNA, 268 bp, Homo sapiens
ccacttcatctgtgtgggaacgtggtcaggccgggtgctggtgtttgacatcccagcaaagggtcccaacattgtactgagcgaggagctggctgggcaccagatgccaatcacagacattgccaccgagcctgcccagggacaggattgtgtggctgacatggtgacggcagatgactcaggcttgctgtgtgtctggcggtcagggccagaattcacattattgacccgcattccaggatttggagttccgtgcccctctgtgcag

SEQ ID NO: 1353 - DNA, 620 bp, Homo sapiens
  misc_feature 545: n = A,T,C or G
cctgagtaattattccatcatagacaaacttgtgaatatagtggatgaccttgtggagtgcgtgaaagaaaactcatctaaggatctaaaaaaatcattcaagagcccagagcccaggctctttactcctgaagaattctttagaatttttaatagatccattgatgccttcaaggactttgtagtggcatctgaaactagtgattgtgtggtttcttcaacattaagtcctgagaaagattccagagtcagtgtcacaaaaccatttatgttaccccctgttgcagccagctcccttaggaatgacagcagtagcagtaataggaaggccaaaaatctccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgnggcttgtatcaacactgttactttcgtacattggctgggaacagtcatgtttgctttcataaatgaagcagcttt

SEQ ID NO: 1354 - DNA, 398 bp, Homo sapiens
aaaggattatttttatgcaaagtattctgtttcagcaagtgcaaattttattctaagtttcagagctctatatttaatttaggtcaaatgctttccaaaaagtaatctaataaatccattctagaaaaatatatctaaagtattgctttagaatagttgttccactttctgctgcagtattgctttgccatcttctgctctcagcaaagctgatagtctatgtcaattaaataccctatgttatgtaaatagttattttatcctgtggtgcatgtttgggcaaatatatatatagcctgataaacaacttctattaaatcaaatatgtaccacagtgtatgtgtcttttgcaagcttccaacagggatgtatcctgtatcattcattaaacatagttt

SEQ ID NO: 1355 - DNA, 371 bp, Homo sapiens
ctggytcctcagtgggaactgagtcattacctgctaaagggtagaagaggagagagagaggccagagcctggggatggggcagaaggtgcagcaggaaggaaggttagagtgagaaaaatttccaaataaggggtgatgtgtgagtgctcagagggtgactgaggacatctccagcatttccattgaggagggaggaaggaggggcccttgggttctggggcagatgccggcagggtctggatgagatgcccccaacctcaaccctggtcctctgaaaacacttcacccagtcacactgaggagcccctccaggcccaggggcccctccaggtaggcgtatctcagctcctctctggaaggacccccacag

SEQ ID NO: 1356 - DNA, 338 bp, Homo sapiens
gcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcag

SEQ ID NO: 1357 - DNA, 159 bp, Homo sapiens
ctgggctgctgcctctggagtacttccccgcagctcctcattgctcacatagtaggcaatggcgttgctctcaaacacacagaatccatcatcaccctcaaatgctgggaccttgccggcaggaaatttgcggagaaattcaggggtgcggttggtttg

SEQ ID NO: 1358 - DNA, 306 bp, Homo sapiens
cctgtcagagtggcactggtagaagttccaggaaccctgaactgtaagggttcttcatcagtgccaacaggatgacatgaaatgatgtactcagaagtgtcctggaatggggcccatgagatggttgtctgagagagagcttcttgtcctgtctttttccttccaatcaggggctcgctcttctgattattcttcagggcaatgacataaattgtatattcggttcccggttccaggccagtaatagtagcctctgtgacaccagggcggggccgagggaccacttctctgggaggagacccaggc

SEQ ID NO: 1359 - DNA, 382 bp, Homo sapiens
agagggagtccagcccccaagccttgtgaggcactgttargcagatagggaaaagaggggtccttagatcactggttcaaggagggatctggtaggggcagcatttcttctgggctggaaacagaatgggggtttcaagatggcagaaccattccattattggagctataagcccctagaattgctccatggcctatctcggtttcccttggatctcatctgctcctgaactgcacctgtcatggcaagtccatctccggcccccatctcccctgagccaatgtgagtcaggtgaacaaaattcattggttccccaatcatggtccggtcaatccgtcttctcttcttctttcttctccaccatccagacgttcagctacag

SEQ ID NO: 1360 - DNA, 365 bp, Homo sapiens
aaaaaacctttcaaaataaaacttagtaaaatctagaactgkttcttggcctacttgagaggaacttccatattttcacagccatctccgaaagcagcagttgctgtaaattaactgagacttggaaatggtgcagactgtcttggtagagctgttcttatagcacaattttatctggaaaataaacttgtaaatgcgtgctgtatattaatacatgtgtgcccatatttatttttattatctcctgccagtctttgctcaatgggagatgacagaccaacttctcaacgtgatttccccatttcattgaatgacatttatatgccacttatgaaaaaaatactgctgtgaaagaaatgtacttt

SEQ ID NO: 1361 - DNA, 502 bp, Homo sapiens
gaggtatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgaacagatacacggaaatcaaactacatgttcctgaatgaccactgtgtctatgaagaaattgattttaaaaatttaaaaattctttgaaacaaatgaaaatagaaacacagcatacaaaaatgtatagggtacaacaaaagaagtgctatgagggacatttatttcaataaacacccacatcaataaggtagaaagtttttaaacaaataacctaataaacgcatctcaaggaactagaaaagcaagaacaaatcaaacctaaaattagaaggaaataaatagtaaagatcagagcag

SEQ ID NO: 1362 - DNA, 545 bp, Homo sapiens
ctgattggatgtctaggaatgactgaaagaaaccaaaacagcctgtccactgctgctgtgggatggaggaggcgtaagcagaaacactaacagtatactgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggacttt

SEQ ID NO: 1363 - DNA, 286 bp, Homo sapiens
gggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctgg

SEQ ID NO: 1364 - DNA, 503 bp, Homo sapiens
ccatcaggatcatgaaaacaaactttggtgaatgtgagcaactgcgccagacaggacacaggttacagggcctgacgtcactaacggtaactgacaatcttggaatggaccctactgctgatgtttcaaaaggacacagaggtgaactggtcacttctaattaagaagagccagtggggtgggggaagctgaaaaccaaaaatccacgtagacatacgtggcagtgtgaacgtctgtcctccccttccttctcctcacttcctctcctcctcctcactcaggctggtattctcctggtgtgcggatgtcagcttgccctgcagaagggctgccagttttttagatgtctttttgagaaacgagctgcccggatgggcactgttcacgtgcaggtacaggtcctcctgggtggggcccgtgtagccgcaatcctcgcagacgtagagcttgtcccgccgctgcttataggcatactgctgctgcaccccatggattttcttcag

SEQ ID NO: 1365 - DNA, 245 bp, Homo sapiens
ctgggcggctccacgctcatccagtgggcctaggttctgactgaccagcgaacaaaaactgtgacagagatctaggatttcattcaggcagtgaaacacctacccgggaaacagagttggcattaggaaaggaaggaaggtacatccatgaagttaaagtgttaggagaacagtctgattaatagctgatctaattaatagctgacctcccaaatctgacaggatagacactgccacgtgcaagg

SEQ ID NO: 1366 - DNA, 131 bp, Homo sapiens
aaaatccccataaatcttttctgtcctgaggtagttgcaaaataaatcataacttggatatcaactagagctgaggctttgactttttactcattaaaactagttgttacaggaactacctttagatattt

SEQ ID NO: 1367 - DNA, 430 bp, Homo sapiens
ctgtgcagttatatgaccataaaggaaatgaaccattaaaaatggatctacagccatatattctgccgttactcagaggcttaatgatttattttccccctccagccctgcctttaccaggttaaatgacagaagaccttctattgtacctattgttcaaaaaatattactgttctgtggaacctgggagagtccaattgataagagaaactgaatcatactgatgaggtgaaggataggtctgccggtgtggggcagggcactctttctcagcagccaagataacttatcacacacgaagcagagagaatgcacccgatgaaaatctctctgaactgtgttccttgaaggatctcttaaaaaaaaaaaatctgaaacatcatccattgaacaaatgaaaggcttatacctttaccatgaagaaacattt

SEQ ID NO: 1368 - DNA, 294 bp, Homo sapiens
ctgggcggatagcaccgggcatattttggaatggatgaggtctggcaccctgagcagtccagcgaggacttggtcttagttgagcaatttggctaggaggatagtatgcagcacggttctgagtctgtgggatagctgccatgaagtaacctgaaggaggtgctggctggtaggggttgattacagggttgggaacagctcgtacacttgccattctctgcatatactggttagtgaggtgagcctggcgctcttctttgcgctgagctaaagctacatacaatggctttgtgg

SEQ ID NO: 1369 - DNA, 429 bp, Homo sapiens
ctgaaggcaatgggggactgaggaaggaggcagcagaagtaggagaggagcaagaatccagaagggaaatgagaacgacaaaactgaagtgcacttcaacatcctgcagccaaaggggtaaaaaggagaaagaagtgcagaccagtcacataaatgccacagtgacatgcacaaaaacgtgaggggcacactccagggacagagtctgacaacatgacaagctacatggcatcaaactctttcatgtgacaggcagcttttcacatgtgcatcttaagactggaacttgctatagataaaccttaagtagttaataaaagcaaaagtcatcctctattcactgtttgctgccatgttccaggcatagtacttggcactttttattttatttcacttgatcagctcagaaagtcctccaaatgagtattt

SEQ ID NO: 1370 - DNA, 540 bp, Homo sapiens
ccactcccaggatgctgggtctcgcttgctggctgggaccccggagccgtcagtccacgcactcccggatgcactcaacaacctaaggacgcaggagggttccggggatggtccgagctcgtccgtagattggaatcgccctgaagatgtagaccctcaagggatttatgtcatatctgctccttccatctacgctcgggaggtagcgacgccccttttccccccgctacacactgggcgcgctgggcagaggcagcacctgctttttccctacccttcctcgattctgtccgtgaaatgaattgggtagagtctctggaaggttttaagcccattttcagttctaacttactttcatcctattttgcatccctcttatcgttttgagctacctgccatcttctctttgaaaaacctatgggcttgaggaggtcacgatgccgactccgccagagcttttccactgattgtactcagcggggaggcaggggaggcagaggggcagcctctctaatgcttcctactcattttgtttctagg

SEQ ID NO: 1371 - DNA, 142 bp, Homo sapiens
ttaaaatggtagcacaagagtctggcaagttggtactgcagagaaaaggggttaattgaggcttgtttggagtcgggattcccctttcccaaacatgcgtctcgccacttggacagcagccatttgtactcgtatacttttt

SEQ ID NO: 1372 - DNA, 377 bp, Homo sapiens
ccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcag

SEQ ID NO: 1373 - DNA, 504 bp, Homo sapiens
ccatgctaagtttgggaaccgctggtgatgggacatggatgcttgcaaccgaccgtgggcggatgtggttgaccagatggcagaggacgacaccatccatgagggctgcccccaggtcttcgtgcagactgaccttcaatctcatctcaatgctctcacgaagttgttccaccagctctttctcttctctcatctgctccattttcctccggattgtaaactgcgggtctatagattccaaatttctctgaggtcttagaaacacagactcagaaatcaaatgaggatgtctcagaaaggagtcacttttccagaggcaggctgccccttaactcagccgagcagcaggaaccactggggccaaagctattttatcttccttaggtaaaaaaaaatcaatagaatatttcttccccgcttacatgctcccaccactgatgaacgcgatcttcagcaagaagaactttgagtccctctccgaagccttcagcgtggcctctgcag

SEQ ID NO: 1374 - DNA, 201 bp, Homo sapiens
cctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattgg

SEQ ID NO: 1375 - DNA, 295 bp, Homo sapiens
  misc_feature 12: n = A,T,C or G
ctgtgaggctgnttccaaggaggaaaacaaggaaaaaaatcgatatgtaaacatcttgccttatgaccactctagagtccacctgacaccggttgaaggggttccagattctgattacatcaatgcttcattcatcaacggctaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactgg

SEQ ID NO: 1376 - DNA, 318 bp, Homo sapiens
ccagcgctactgtactggcccagggcagagttcatgtatctcgtcttgaccacgtctacaggggaggcgatgacagtggtgcagaagcctgccccaaaggcagaagtgaagtggcaagggaggtcatctgtcatgaggttggctttcaggagggcatccttgatgaggtcataggtcaccagctcagcacagttgacaatggcattacgagcaacattgggggaggtccctttccagaggccccggaacccttcctctcgggcaatggtcttgtaggcattgacggtgctttggtatctccgaccacctccagcccgg

SEQ ID NO: 1377 - DNA, 143 bp, Homo sapiens
gtggattccgytccgggcaccgatctcgccaagatcctgagtgacatgcgaagccaatatgaggtcatggccgagcagaaccggaaggatgctgaagcctggttcaccagccggactgaagaattgaaccgggaggtcgctgg

SEQ ID NO: 1378 - DNA, 98 bp, Homo sapiens
aaatattggtaataggtcggcaacagcaactatagaagtacaactcaatagatggcattaaaacatattgtagtgtggatatatattttttctttttt

SEQ ID NO: 1379 - DNA, 330 bp, Homo sapiens
aaagatgttcacgttacgctggaccaaattaagacggctttctccctcttgctgacgtgccccagccgtgataatgaccagcttggagtttgcagttacattatagtctttgccagagacaatctttggtgttctaaggaaaaggctgccatgttggagatccatcatctctcccttcaatttgtcttcgacgacatcaacaagagcaagttcatctgccaagtccttcattaagatactgatggcacaggccatgccaacagcaccaaccccaacaactgtaatcttattctggggggtctgttcttcctttagaagattataaatcag

SEQ ID NO: 1380 - DNA, 269 bp, Homo sapiens
ccactcctggaaacccactgatagatgagtttcccccattcttctggcctccgccacatgatcaggaagctggacttgctcttatccaaccactcgaggttccctttcttcctcagttcctctaatacaatctggatcgactccacaggaagctttcgctgtagcttgacgttgttgaagagcgggctctcctgagcttccatcaccgtcatgctggactgtttgtgcaggcggcagaaggacaggaccagcgagcaccaggcggccag

SEQ ID NO: 1381 - DNA, 232 bp, Homo sapiens
aaaagagaggaaaggcagtgcagggctggaggtcctggagggtggcggcgggtcgtcctaactagcaggctgaaaggtgctggaggggatgccttcactcagaggaagttcacagccacctgccttggaacatgtacctgttcatcttttcgtaatgttagtattcattttgctatcttcctgttgccatttccaaacagtgtcagtatgtttttgttaaatacgaacattt

SEQ ID NO: 1382 - DNA, 348 bp, Homo sapiens
aaacgtgctaaagggaaaggaatctgacattctgggtaaatcttactcaatctaaatcaaagcttggttttcaggaggaggaaggtgcgagcgcaggcagaggtgctgaatactcctcttctgattcacttccatcatcctctttctcttggtcactgccctcagtgctaagccggtcaaacccttttcgactgtagcccttacggcttgcaaagaaattaccaaggtttaagcctccacttccctttcctctaaatcttcccagtactcttcctgaactcgtctcgagtttgtgttcagaatctccaaaggcccttgattttttccaccgaataaatatggcaatgg

SEQ ID NO: 1383 - DNA, 293 bp, Homo sapiens
  misc_feature 10: n = A,T,C or G
ctgcttcaanacctcagcttcatgggacttgcgtctttcttctgcagcttctaatttcttctgaatttcctccagggaaagatccttcttctttggaggggaaagggggaattctggaacagattcttttgaccgagggctgagaatcagctcaaaagcctggcccgaggcacgcttctccagttctttcacctggatatcagaagaagccatggtgaatagaagacaagcgacaggcagtgtattctgcacaatcaactgggataaggaaagtcctgctcagtccgagccgc

SEQ ID NO: 1384 - DNA, 573 bp, Homo sapiens
ctgaagcaacttgggattaattgcttgattagcttcacgaagcacagagataaggtcgctcacttgctttatgttattaggtgtaaagaaagtgtatgctgtgcctgttttggtactgcgagcagttcttccaattcgatgaatataatcctctgaggagttagggtagtcataattgatgacaaatttcacatcttccacatctagccctctggaggccacatctgtagcaatcagaataggagcttttccatgtttgaattcatttagaacccagtcacgctcttgttgactcttgtcaccatggatacccatggcaggccacccatctctcctcatttttctggtaagctcatcacatcttcttttggtttccacaaaaacaatggttttattctccttctcactcatgatctcttccattagacgaataagtttttcatccttttctacgtcatgacacacatccacaatctgaagaatgttgtggtttgcactcagttcaagtgcaccaatgtttatatgaatatagtctttcaggaaatcttcagcaagctgtcttacttcttttgg

SEQ ID NO: 1385 - DNA, 150 bp, Homo sapiens
ccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtgg

SEQ ID NO: 1386 - DNA, 159 bp, Homo sapiens
  misc_feature 139: n = A,T,C or G
aaatgatgttttggttaagagtggaccatgagaattagctgacagcatcccctttctctctccctgccttggtgggaccctccctgtgtgaccttggtcaagtcctcgaacttttgtcccgtatttaagatggagctgntttacctacttcataagaca

SEQ ID NO: 1387 - DNA, 735 bp, Homo sapiens
  misc_feature 5, 20, 41: n = A,T,C or G
ggtgnaattcgcctttgaanggccgccgggcaggtcctttntgtstgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgccctttctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcaga

SEQ ID NO: 1388 - DNA, 369 bp, Homo sapiens
ctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacag

SEQ ID NO: 1389 - DNA, 322 bp, Homo sapiens
aaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgccgccatcttagctgtggacaaaggggggtcag

SEQ ID NO: 1390 - DNA, 450 bp, Homo sapiens
aaatattagwtgagactttacaggcacataactgttcagatagaaacaaacataacagactaaaatactttcaaaattaaagccatctagaaaatggaagtaactgaaactgtagccattacaattctttttctggttttgagcaaaaattttatctctctggcaaaacacctttgtctgatcatttgagagacagggttcttgtatactgtttcttcaacgtaaacctcatttacaaaaatagtgacatagcattatgaataaactatgaattggggaccatggaaatgcactagaacaaattttgtaaaaatatggcagatatggaagttaaaaatagaatggatgcaaggactgtactaaaggtgtttggtgtagttacaatgttcactttgcacaactatccctatagtctaggtagccattgggtttctcctcagcagtgtcaga

SEQ ID NO: 1391 - DNA, 304 bp, Homo sapiens
aaaaaatcataaatggggtttcataatccaaagttgaaacatttattcttcatagcttcagaatttaacaaccaattgtagaccatgctttccaaatccagtcttctttgctatttttcaaaacttctgagatctagtattaaactgctccattctaaatgtatagttttagataagtattgtacacttgttgataagggttttctgaaagcagtctatcaaatataaagaatggtttctatctaagaatcagcagtgagggaagaaatattaaacacctatcaagaaatcaattattcatttt

SEQ ID NO: 1392 - DNA, 140 bp, Homo sapiens
ctggaagaagaactgagacagcagaaagaagcagcttgtttcaaggctcgtccaaacaccgtcatctctcaggagccctttgttcccaagaaagagaagaaatcagttgctgagggcctttctggttctctagttcagga

SEQ ID NO: 1393 - DNA, 166 bp, Homo sapiens
aaaactttgtttttcttaaaagcttacagtgtttggctaattctcctcccctttttacaagacgggggccggagggtggacactggtggcaggttaagggatactgtcactttaagaagcctgcagattgaagtgtaaacatggagaaattaggggctgatttttt

SEQ ID NO: 1394 - DNA, 543 bp, Homo sapiens
gcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttctaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttgg

SEQ ID NO: 1395 - DNA, 364 bp, Homo sapiens
cctatcatcagtggggttgtattcaccatcatccagggtaccatcttcatacaaggtactagctatgaccaaccgaaacttgtcacccaagtctacagggtaaatttgaatgtttacatctaagattagatccatcttgaaagattcactctcacaatgcagtcgagacactcggtcaaacttcttgccctccgggtcaatatccttcacatcgaaaatatcctcaaacaggatgcccgccatcgcgagggggccacgagagcagcagaaggggtgagagcgcgaccacagttgggagtacgtgcaccccctagcgtggacaagaccggagagaaccaaaagcacctcctgaaagcgcggcggc

SEQ ID NO: 1396 - DNA, 422 bp, Homo sapiens
gctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcag

SEQ ID NO: 1397 - DNA, 653 bp, Homo sapiens
ctgacctgctatcccaccccaaatttcagcctgaggtatatttcagtgaaggcaggtagctgtgcttctcagagcagagaagcagttttaagagcaaaaaggtagaggaaatctagaaaagaaccgtcttgatacagatttatcccatggtgtgaagggagggcaaagaacccagtggcacttcgcttatccagcaatttctgtcactgtggtgaccaacttctgcccgttccatagggtcttgaactgctcaggaactgggaattcattaaagtcaccgccttctgtaggaatgaggacattcatctcggaagatttggcactgactatttcacaatccagggaattcttgctcaggtaagcatggcagccatctgttttgttgatggatatggttggcactttacccattacctgaactttgacatccttactgttgattatctccacaatgcccaccacgtcatcgaataccaggccaagtttcttacagttatctactgtaatggagttaattttgcccttgatttgcaatgtcgtgttgacacacttgtatatgtaagccacctgtttcagctctgtgtcctcaatcaccagggtggaaacattttcctgattttccctctcccttcttgccttcagttcaagtacag

SEQ ID NO: 1398 - DNA, 261 bp, Homo sapiens
aaaattataactactcattctttctttagccttagataatttgagcagaagccacaacaagcaaaccacaataaatttagaattggcagaaatccacattaactcctcttcccaagtttccacactactaccatttacagttgtaggtttgtaatgtataattatgtaatgcasaaactagctttgacttgtgtracgatgcactgtcaaaggaagcaaagtaagaattgaaattccacattcccagaatttaacactcag

SEQ ID NO: 1399 - DNA, 195 bp, Homo sapiens
ctgattttatttccttctcaaaaaaagttatttacagaaggtatatatcaacaatctgacaggcagtgaacttgacatgattagctggcatgattttttcttttttttcccccaaacattgtttttgtggccttgaattttaagacaaatattctacacggcatattgcacaggatggatggcaaaaaaaagttt

SEQ ID NO: 1400 - DNA, 120 bp, Homo sapiens
ctgcctccaaccctttgggtctccaccacccaagtttcctgtagggtccgccgggtccaggatcacaggcctgggtttcgtgagctgccttctcaggtacttttcaataatggggttttt

SEQ ID NO: 1401 - DNA, 284 bp, Homo sapiens
ctgtagccaaaaagatgctggggcagattgtggacaagtagaagcacctccttcccctctgcgacattgaacggcgtggattcaatagtgagcttggcagtggtgggcgggttccagaaggttagaagtgaggctgtgagcaggagcctctgccaggggacatgcaatctgcagggaggggctgaggggggtcccatggtctctgctgtcttctctgtccacctctttgtagaggagcttgagctccaggaatgctctggtcagggctgctgtgactgttggcc

SEQ ID NO: 1402 - DNA, 198 bp, Homo sapiens
ccaggtttctgctggtaccaggctaagtagctggtgctggcgggaacactgtgactggccctgcaggagagggtggctctttcccccggagacagagacagcgtgtctggagactgtgtcacttcaagctctgcgatgccatctgggagccagagtagcaggaggaagagaagctgcgctggggtttccatggttccc

SEQ ID NO: 1403 - DNA, 441 bp, Homo sapiens
aaactcaaaattgacaaattaactagcttgctttttgtcatttggaagactaccattattcaaatttattatgtaatacactcatccagataatgaaacatctgcgaaaaaaagtgtgggaatcacctcatctgtgcataaaatggctattatacatgaatgcagacgtttgaagttagaaaggaatataactcaaatagcaaaaggtcctaattacagagtttacaaataagcagttttattttcaaaagtacatagtaagtccagactgggctattgccaaagaactaatctttagtctacttcaacatgttacatggtattcctgactctacagactatcagcatctgtggaggttagctcctaaaggtcccaaagaacaggaaacatgcaggaataaaggactcctcatgaagagcaggtgggagcgagtgggcagg

SEQ ID NO: 1404 - DNA, 243 bp, Homo sapiens
tgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatgg

SEQ ID NO: 1405 - DNA, 168 bp, Homo sapiens
aaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgttt

SEQ ID NO: 1406 - DNA, 486 bp, Homo sapiens
ctggacatacagaaattgttgaatttttgttgcaacttggagtgccagtgaatgataaagacgatgcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaagaaaagacacccctgcaagtgg

SEQ ID NO: 1407 - DNA, 560 bp, Homo sapiens
aaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggagttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatattt

SEQ ID NO: 1408 - DNA, 360 bp, Homo sapiens
ctgcctagttgtagttgacagacaactttataagctctagtcaaccctattgactaagcttctgaaccactagcatagttctagggtcaggcggatgcctactgtgggcaggaaagtgatgcatgcatgtgtgggagcagtgtcttaatgtctgaaatagtagccatgagctacatgtggctatggagcacttgaaatgtgggagtccaaattatcatgtgctgtgagtgtaaaataatatgtttctaagaccgtgtgtgaaagaatataaaatatctcattaaaaaatgtttatattgagtacatgttgaaataattttatatttgtgacacattgtgttaaataaaatattaaaattt

SEQ ID NO: 1409 - DNA, 208 bp, Homo sapiens
ccagtccaacctgctcctcattattgtataaatgagcagaatcaatatggcggaagccagcttcaattgccaatttggtggcctctaaagctttacttttaggaacctctgcaggcgcataggtgccaaatcccaggacaggcatgaagtgaccatcattcagcttcacacactgatatttcgaatccatttctgtcactagcctggc

SEQ ID NO: 1410 - DNA, 404 bp, Homo sapiens
aaaaaaaggaaaaagttttattacgaaactagtttgtataaaacagggttatacatatttttgtaagtttgtaataaaacagtaagaaaaaaaaggcagtaatagaaatctccaaaaggcaacctatcaaaaccaactggctgccactttgagtttggacagtagctgcataaactttgttcttcttgarcagtatttaataacatcattaatacattaacaacatttctataaagtaagacacattggtgctgaagtacaactggtggcctcttgatctcacctatgaggagagttctttacamawccacatagggaaaattgcagttgtaaggtgarctacacatctaaaatatgcagaggtaatagcattacatgttaaagtatcaagatatacacatttt

SEQ ID NO: 1411 - DNA, 623 bp, Homo sapiens
  misc_feature 428, 469: n = A,T,C or G
ccacttgttgagatatggggagcctacactccggagggstgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgnatgggctggtggctgccatgcagccccgaatgctggttacngtttgatgaggagctgcggccattgccagtgtctgtccgtgtgggccaggcagtggatgtggtgggccaggctggcaagcccgaaaactatcacagggttccagacgcatacaaccccagtgttggtgggcccacggggaacgggcagaattgg

SEQ ID NO: 1412 - DNA, 171 bp, Homo sapiens
gcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccag

SEQ ID NO: 1413 - DNA, 189 bp, Homo sapiens
aaaagtcataagggttttattttgtatcatcaaaatattctataaggtcccaaatactctttttcaacccatgaacagtaagaatttgtgaattctgataatgaaaaaagttttcctccaggtatgtttgtttcacattcagtcctaaagccttgagctatgtgtacttccctcacacaggaacaccag

SEQ ID NO: 1414 - DNA, 564 bp, Homo sapiens
  misc_feature 511: n = A,T,C or G
cctccccagcgcccaaaggtctattacaagtacctatagacttttcacatataagttctagtgggtacaagctttttttttttttttttttttttttttttctattgggkatttcattcattttggggggggaacaaattctacaaactgctttaatattgkcctttttttctaatattcacattaactttttatgtaaaacataccaatgcttttaataaagcttacataggaataaactattatagacctgcatagatataagtacccatgtattaatctacattaaaataatggattttattctgcgaaractccaagttgctcctgggkgctaagkgaagcacttagggaaatgtgttcagtctttgaggtcataggaacattarattatatcaaaggaaacctggagccatcagctaagtggcccttctgtcctgtagatacataaaaactaatgggctccgctatgcggctcactttctgctattagatactatgaggcactaanaaaaaactactgcctgcatcatatctttcttcggtttgagataaagagaatgg

SEQ ID NO: 1415 - DNA, 231 bp, Homo sapiens
ctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccatttttttttgtcttt

SEQ ID NO: 1416 - DNA, 540 bp, Homo sapiens
cttgatttaggatctgtggtgcagggcaatgtttcaaagtttagtcacagcttaaaaacattcagtgtgactttaatattataaaatgatttcccatgccataattyttctgtctattaaatgggacaagtgtaaagcatgcaaaagttagagatctgttatataacatttgttttgtgatttgaactcctaggaaaaatatgatttcataaatgtaaaatgcacagaaatgcatgcaatacttataagacttaaaaattgtgtttacagatggtttatttgtgcatatttttactactgcttttcctaaatgcatactgtatataattctgtgtatttgataaatatttcttcctacattatatttttagaatatttcagaaatatacatttatgtctttatattgtaataaatatgtacatatctaggtatatgctttctctctgctgtgaaattatttttagaattataaattcacatgtcttgtcagatttcatctgtataccttcaaattctctgaaagtaaaaataaaagtttt

SEQ ID NO: 1417 - DNA, 350 bp, Homo sapiens
  misc_feature 3: n = A,T,C or G
ttnatcatctaactgtgggatctatttcatttctggaaataacacaacttagttctagggctttcatgcacatgaaatataaaacagcttagttgttctgaaaacatgacaatggttaattttattcaagtcccaacactgagttcagagcacttctccataggccccattaatctctccaggtttctgggagtatcattaaatccctcggcatccttaagaagcaggtgcttagcaaacatccagtttccaaatgagagtcagaggggcttgatcctgaaagtgtagtattttcctgccttgtcctactggtatagcttcttggacctaaaatctctctcctgctgagg

SEQ ID NO: 1418 - DNA, 425 bp, Homo sapiens
tgctaggcagccttattttcataacccawttagggaaaggaaatttaggattttcaaggctacattaatttttcctccatcaaatcttgatttgttcttgataaaaatgagttcttttggggaaattctttctttagacaccaacttggtttttctcatcttccacagaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgccggggtaataccag

SEQ ID NO: 1419 - DNA, 390 bp, Homo sapiens
aaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggctttt

SEQ ID NO: 1420 - DNA, 480 bp, Homo sapiens
  misc_feature 322: n = A,T,C or G
ttgctgaacaatgacatcgttttctccaggggttgaaatccatgtccatggctgacaacccaacaaggctgggacccaaattcgtacagagatgaggcagagtggagagaaacaactctggctgagccagagtctccagccactacttcttattcctgggctttagctcttcggctgcattacgcaggaaaatgtaattttttttctggggattataaaattcatgtccctttgaccagtcgtagctggaagcgtatgcaaatatgtttccattgygattgaaacagcaagctgasatgggctgayctaactgttccgaagnttttagttttgktctggcatctttgycccagaagctgaatctaccatcagatcccacagttgcaagggtgccatgaacaggatggaacgccgattccatttacccgcataaatgycctgaggagctgaagtgttggttccattagatcgatgacattt

SEQ ID NO: 1421 - DNA, 453 bp, Homo sapiens
aaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagcttt

SEQ ID NO: 1422 - DNA, 542 bp, Homo sapiens
  misc_feature 4, 151, 166, 220, 231, 308, 349, 364, 511, 528, 537: n = A,T,C or G
tttncttgaccactatacggcacaacctaggggstgtawaaaacctascrcaatgcagaagggtgaagcttcatgacaattggtctcggcaataatttgggggatgtaacatcaacgaatcagacaacaaaagcaagggaatacacatggnactaaatcagtgtgnggaaaaatatcccaaacaggcaaagcacaacatggamtagatatatgcacattnatggaccctgnaggcakkactcacaaacatactacctgggaagcamctggacctttaagggatgaggtagattcaacaaacagggcancgtatmttccactgggatagcattccagccttaaaaataangaaatcttgaaaagnactacaataaggacaaatctcgaacacattctgttaagtaaaacaagacaagccaaaaagggaaaactgtataattacacctatgtaaaatatttagtcaaactcaaagaaaccaagtgttgtagtctcagcagggcaccaagatgnaaacagtctctcatagnctgagatangcatc

SEQ ID NO: 1423 - DNA, 252 bp, Homo sapiens
ttaatgccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcag

SEQ ID NO: 1424 - DNA, 273 bp, Homo sapiens
tttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgagg

SEQ ID NO: 1425 - DNA, 618 bp, Homo sapiens
aaaaaccttgtatagcaaaataacttaaaaccctttgtgatatcatcttaccagtttatttggtaaaaacaaacagttatttggtatttgtcagaattcttcagtgcctgctattacagctattttccaattactaatttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaatttt

SEQ ID NO: 1426 - DNA, 565 bp, Homo sapiens
gtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaag

SEQ ID NO: 1427 - DNA, 144 bp, Homo sapiens
ccactagttatttttatgtaatcaattacggggtcattagttcatatcccatatatggagttccgcgttacataacttacggtaaatggccgccaccgcggtggagctccagcttttgttccctttagtgagggttaattgcgc

SEQ ID NO: 1428 - DNA, 214 bp, Homo sapiens
ccactagttattattatgtaatcaattacggggtcattagttcatagcccatatatggagttccgcgttacataacttacggtaaatggcccgcctggctgaccgcccaacgacccccgcccattgacgtcaataatgacgtatgttcccatagtaacgccgccaccgcggtggagctccagcttttgttccctttagtgagggttaattgcgc

SEQ ID NO: 1429 - DNA, 253 bp, Homo sapiens
  misc_feature 12, 16: n = A,T,C or G
ccactagtccantttngtggaattctgaagccttaattgcttatatccatgtttctagtgaaatgagagggtataacaaaaaagagaacaggaggaaagcttcgctgtgcctgaggaaataatctagtcaaggcagcaagtctggatagtgctatagagatgagatacctgagcagttccagaggaagaggtggagatcagaggccagttttcagtgaacactgtaaagaaaagccagatgatgtgtcctgga

SEQ ID NO: 1430 - DNA, 232 bp, Homo sapiens
aaattttactagtgttacttaatgtatattctaaaaagagaatgcagtaactaatgccctaaatgtttgatctctgtttgtcattactttttcaaaattatttttttctgtaaagtataatatataaaacttcttgcttaaattgaatttctatattagtggttaattgcagtttattaaagggatcattatcagtaatttcatagcaactgttctagtgttttgtgttttt

SEQ ID NO: 1431 - DNA, 734 bp, Homo sapiens
cattatacaacactatattgccaggtcaaagagggcagggacgtaaatgtacactaaaatgcmaatgtatcccaaagagataaaacaaattccatttacagcatgaaggtttacaaatgtacacctgtacaaccaaggaaagcatcactactaaattagcaaggcttttataataaacattgaaasaagatttcctttcaaagtgtaaacttacatctattactacacacacaatgcatatatttatagaaagcaaaaagagctatctgaatatgtaatcatgcttaaatgctgagctatcaaattcacttttcagtggccccttttcatctctatctggttcctactttctgcctctatgaaaaagcaaaataaagctcaacacttcctcaacatgtctgtaattctataagcaaaacaaaatacaaatttccactctttctcattgcaaaccaaactgaaaagttaataagtgacttaacttttcatttagtgcacttaattggaagtgtcaccatgattttgtatttaactcttacaacaattacatatgtaagtatatacaatatttctgtacattgccagagacattttagggcagtaattgtattaaaaccacatctactgtaaataatgttaggttcttttcatctcaaaccactttattcttgcctacttactcgttatttgcatgatagtttgtgaattatcaaaatacaacttaactctttaaa

SEQ ID NO: 1432 - DNA, 542 bp, Homo sapiens
tttaagaaagagcctttgagaaacatgcatacttttctcttttctcctatattcaatactcatatagcctaaaagatggaaactggttcaagaatttaaatgacttgttccctaaaaagttaatctcctcacctttgtgaaatatatcaagtgctttctataaataagggcaggaaatgctaacttcataagcatagtcctagtcattaaaataatttgatcatcttctaaaatttaagtatgatagtaacacagtaatatggaaaatctcaatatacttaacacttcctaaacagcacaatgaaatgttgttcaaggtctgaattaatttgctacaggacctaagcaagtctgtttgcttatcttttggctttaaaattctttaagtctaaaatggtgataattttagaataaactgacaatgtggggaacaaacttaaattcacaaacactacccatatgctcaaaaactctctgggataattagtttcttcattgtaactattgatgtactattatttcatctttccattagctctact

SEQ ID NO: 1433 - DNA, 175 bp, Homo sapiens
ttaaattgattcaaaaaaacttgacacctgtcatgtaggccacaaaatagtagcgaactatactaagtggtatagcccactgtggagtgtggtcttttactcttccaaatagcccaagttggcaaaggttacttaaaaacctgccccccaaaaagctaacttttggtagattttt

SEQ ID NO: 1434 - DNA, 90 bp, Homo sapiens
ttaatcactattgatggaagcttatattccttatgaatatatacatgtatgcatatatacatctctgtatgaatcactcaaagcaatttt

SEQ ID NO: 1435 - DNA, 153 bp, Homo sapiens
tttacctttgtgctttgaaggttctaccatttakaaagtaaaaagccaacccacagaatggaagaaaagaggacagactctaacaagcgttcacaaagatggagagaaattgtaaccctcatatattgctggtagaattgtagaaagatgcag

SEQ ID NO: 1436 - DNA, 483 bp, Homo sapiens
  misc_feature 36: n = A,T,C or G
tttttagtttaaagaagagttttgccacttaracangggagctwtgtctggaaaatacactgagttgaaacacttcatccttggaaggattatataagatgaacagytgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagytttcttataatgttgaaatgttttagaatcctttgaatctaagtatttgtttcctaaatgaaacatttgtacaacatttgatgtttttacttatgaaatattctcctcccccaagaaaattt

SEQ ID NO: 1437 - DNA, 171 bp, Homo sapiens
ttttgccacctcaagaagccattttcttgtctgtttccttctttacctacccctacaacctatgaacaaataccataacttaaaaatttaggtagtctacaactcctacaaattttaagttcagagactacccaaagaactgtggaagatgcagcaatataaaagtttttt

SEQ ID NO: 1438 - DNA, 408 bp, Homo sapiens
tctgagtggaggtaggctaacaacacattttgactttstcctcaaaggatagctttgaaaaacaagtgtaaccaattgttacaccaaattaaaatggcaatattaaatcggtaacaaaacgatccacattttatacaatattgtatttccaaacatacataggtcatgaaaatcagagaacctaatatagcaccgttgaaaccattcattatccttcatgtgtgtatgcaattcagaatttcggcagaagacaacaaatggaaaatgcctttcgtttctataaatcattttggatttcaattaaatctttgccttagtaaagggtattcttatctcaagatcaattagccgtttttagctccaccgttttggaagtaaaaatgatgagctacatctactttttaattt

SEQ ID NO: 1439 - DNA, 168 bp, Homo sapiens
ttacacaacagctataaacctgaacacatatgctatcatcatgccataagactaaaacaattatatttagcgacaagtagaaaggattaaatagtcaaatacaagaatgaaaaacgcagtacatagtgtcgcgaactcaaatcggcatttagatagatccagtggttt

SEQ ID NO: 1440 - DNA, 307 bp, Homo sapiens
tttcacatacgaagaaatcaactgtgattatgaagtgacagccagctaaatatgtcttgtattttctctcttcctttttttgcctaactcatcctttacttccattcctgcttccatggtaatgcaggctcaaataaattactaggatacaagattacttcaagcctcttttctgtggaactcataatatgataagcatttgttacaagattgcctgtagttgtttaggggacaaattatattagggaaagaaagtctttctttagttggttaaattttctattataattgggtactaaatttattt

SEQ ID NO: 1441 - DNA, 684 bp, Homo sapiens
  misc_feature 600: n = A,T,C or G
ttaagttctggagtgttcacttctgagcctgaattccctcccctgcaaaatgggggaataccctcctcagagggtccctgcgagggtgaggggagattcagcatggcaggtgtgctgggcacggcagggcctgggaagggcagatcctttccccatccctgccacaaacaacccaaacctttaaaggagagcaatggccttgtgtcaaaaacaaaaacaaaacaaaaccctgtcctaggagactggggccctaatttctaatagcaagcctttatgagtccctaacactctactgggctgagtatctcacacgccagaggataacctgccttctgctcaccaccaccccgtagtagttgtcattgtgtccatttcacagatgaggcaaaggctcagaagagtcatgtgttaaaccagcttctagagcccatgcaggagctgcaggtgggagaatcacctctaggtgctcttcccatagaatcctcacctcctgagtgtcactcactcagcttccaatgggtgtgtgacctttgaccagctttcttcctctctgggcctcagtttcccacctggacaaagtaagaggtctcttggcttcangtaagttcttcctaaacttctttttccttttcatttgagcatcctcttcatttttgccacctctctgtcatttacaggcttttt

SEQ ID NO: 1442 - DNA, 166 bp, Homo sapiens
aaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaagaacaaagtttt

SEQ ID NO: 1443 - DNA, 194 bp, Homo sapiens
tttgccctgtcaaaagaagagctaaagacagttatataaaaattaaggtgggctttcagactggctaacacaacaacattccatgagtagatggtaatttatttttgtttatccatttcgttgggagcaaggacaaaaatgtaaatctacaccttgcttatcaaaattgccgaaaaaagaatgctctgcctttt

SEQ ID NO: 1444 - DNA, 96 bp, Homo sapiens
gagagtcgagagtgggagaagagcggagcgtgtgagcagtactgcggcctcctctcctctcctaacctcgctctcgcggcctacctttacccgccc

SEQ ID NO: 1445 - DNA, 365 bp, Homo sapiens
gggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaggagcaggtggcagcaggggaacgtcttctcatgctccgtgatgcatgagggtctgcacaaccactacacgcagaagagcctctccctgtctccgggtaaatgagtgcgacggccggcaagcccccgctccccgggctctcgcggtcgcacgaggatgcttggcacgtaccccgtgtacatacttccc

SEQ ID NO: 1446 - DNA, 386 bp, Homo sapiens
tctggaaagttcttgctcgggtcccttcacctccccgccctttcttaragtgcagttcttagccctctagaaacgagttggtgtctttcgtctcagtagcccccaccccaataagctgtagacattggtttacagtgaaactatgctattctcagccctttgaaactctgcttctcctccagggcccgattcccaaaccccatggcttccctcacactgtcttttctaccattttcattatagaatgcttccaatcttttgtgaattttttattataaaaaatctatttgtatctatcctaaccagttcggggatatattaagatatttttgtacataagagagaaagagagagaaaaatttatagaagttttgtacaaatggttt

SEQ ID NO: 1447 - DNA, 261 bp, Homo sapiens; identical to SEQ ID NO: 288

SEQ ID NO: 1448 - DNA, 404 bp, Homo sapiens
aaaaaaaggaaaaagttttattacgaaactagtttgtataaaacagggttatacatatttttgtaagtttgtaataaaacagtaagaaaaaaaaggcagtaatagaaatctccaaaaggcaacctatcaaaaccaactggctgccactttgagtttggacagtagctgcataaactttgttcttcttgaacagtatttaataacatcattaatacattaacaacatttctataaagtaagacacattggtgctgaagtacaactggtggcctcttgatctcacctatgaggagagttctttacaaaaccacatagggaaaattgcagttgtaaggtgaactacacatctaaaatatgcagaggtaatagcattacatgttaaagtatcaagatatacacatttt

SEQ ID NO: 1449 - DNA, 230 bp, Homo sapiens
aaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagargcttcttgctgaattttgattctgcag

SEQ ID NO: 1450 - DNA, 194 bp, Homo sapiens
aaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctatttt

SEQ ID NO: 1451 - DNA, 106 bp, Homo sapiens
aaagatgacaaatactggttaattagcaatttaagaccagagccaaattatcccaagagcatacattcttttggttttcctaactttgtgaaaaaaattgatgcag

SEQ ID NO: 1452 - DNA, 349 bp, Homo sapiens
ctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcattta

SEQ ID NO: 1453 - DNA, 302 bp, Homo sapiens
aaaaataatgtgcaagagcatcatgagaaagaagaggggtgaagagataatccagaggaacatcaaatgtaagagtatacactcaaagacaggtttaagaaagaccagtcagagaagtaaagaaaaaaatcaagcaagaataatgttgcaaaaattaacaagaaagttgcaagcccagagtggttagcaatgccaaactaccatgagtaagccacataaaacaagaactttgggttcaactgctttaacaatcagacctttagattcacataacaggagttacaaaattaagagcctctttt

SEQ ID NO: 1454 - DNA, 268 bp, Homo sapiens
caagcgtaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcag

SEQ ID NO: 1455 - DNA, 207 bp, Homo sapiens
  misc_feature 29: n = A,T,C or G
ctgtcgagagcagccctgcccaagawtgncgggtgggggctggtgccaacgggttcccaaggscctttcmactttkgaakggctggarttcttgggaaaccmaaacsktgactacctgscttttttcttgggcatygacstgcttcatttccaaaratgatggkgcaggtgaccttttccatcgtgagctaaaaaaaggttaggagg

SEQ ID NO: 1456 - DNA, 181 bp, Homo sapiens
aaatttctgtctgctaaaatctatcaaatacattaaggaaaagtcccacttggcacatctcccacaccagatgttaattattcatactgcatgactgaggattttggaggcagagagagattcatctgcaatatttggaacaccaatggaggtctacgtcaacacagaatttatacagcag

SEQ ID NO: 1457 - DNA, 309 bp, Homo sapiens
aaaaagwtcagagttgaaatgcctttcaaccattkccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgacttt

SEQ ID NO: 1458 - DNA, 117 bp, Homo sapiens
aaagactattgagaaataggaaggtattgagagattattgggtttcatcakagcagacttaagtagcctggttgattttagatttgtcacagcaaaatcatgcttggatgctcgagg

SEQ ID NO: 1459 - DNA, 575 bp, Homo sapiens
  misc_feature 371, 379, 428, 469, 498, 506: n = A,T,C or G
aaagaatgcataccagaacatttataagcagtggagtgagkthtattaagaatagtactactacaataaacgctggctaaataagaagtgcattatgtgaagcactatgggtggtatatgcttwgmcacatactctkgttaccttgaggyagatmacrcatgkgaaccaacttcggcatacattttcagttgctgcgaggaatcatgtgttttaacgaaatgcgtcagtatgaaaaacttgaaaatattcatgaatgawgaacgcmttaggaaaaaaatakstattctcatgcaattatgtacagtctcactgtgtaratctcaaggcaaggtttgcctcctgtaaaccagatcaaggtgctatgagagancgccytgncttattgcatttcttttctcctmctgcgccagcattatattgctctagnctttatttttgtgtgcacactgacatgccattaaaratgangractatctcacatgtagaaaargaaagnmcttggankctacctcaggtcgctaccacgctaagggygaattctgcaggatatccatcacactggcggcgcgattg

SEQ ID NO: 1460 - DNA, 444 bp, Homo sapiens
ctgggggttccttccttcacgttgagaacctggagcagagagtctaccaacttaagaaatattagaaagagttcagcaaacagagtgagctgaagtctaatcctagaagtaaatccattcctacaagtcatcagcatcacttgggagcttgttagaaaggcaaattcttggttcagcctaacacctactaaatcagaaactctgggggcggagcgcagcaatctgtactttcacaagccctgcaggtgattctgagcctgtaaaatttgagaaccagagctgtcccccaggagataaattaacttctacttttttttgagctactgcattttgggatcttattgttttatcagcttaacatgcatcctgatatgattactcaggtatgtttcaaccaatgttggttaatgtattatccccaggaacttattactagaggagcag

SEQ ID NO: 1461 - DNA, 536 bp, Homo sapiens
ctgcaaccctgggactgaccgggaggctctgattatttacccmaccacaggtaggttgtgttctgaatctcaggttcacaggttaaggttcagcatcctcatcctccacggggttggagttgttgctggtgatgaagggtttgggtggctctgcatagactgtgatcgtcgtgactgtggtcctattgaggccactggctgagttattggcctggcaggtatagagtccgctgttcttctcagtgatgttggagataaagagctcttgtgtgtgttgctggatgttcccatcaatcagccaagaatactgtgcaggtgggttagaggctgcatggcaggagaggctgaggttcacccctggacggtaataggtgtatgagggggaaatggtggggkcrtcygggccatagaggacattcaggatgactgrgtcgctgtgstyarcacttaatkcgttctggattccacactcatagggtcctacatcattccttgtgacaytgartagagtgagggtcctgttgtcattggacagm

SEQ ID NO: 1462 - DNA, 409 bp, Homo sapiens
ctgakagaccaggagaagttccagatgcagagactgtgatgctcttgactatggaattattgcggccagtagccaagttagagacaaaacaggcataggtcccgttattatttggcgtgattttggcgataaagagaacttgtgtgtgttgctgcggtatcccattgatacgccaagaatactgcggggatgggttagaggccgagtggcaggagaggttgaggttcgctcccgaaaggtaagacgagtctgggggggaaatgatgggggtgtccggcccatagaggacatccagggtgactgggtcactgcggtttgcactcactgagttctggattccacatacataggctcttgcgtcatttcttgtgacattgaatagagtgagggtcctgttgccattggacag

SEQ ID NO: 1463 - DNA, 502 bp, Homo sapiens
ccttcagcctggatcctttatattaagatcaatgaggaccatttctggaagatgtctggcatggtacagactgtctgaggccractgaacacaggcccttaccctgattttatcagtgaaaagctatgggactagtttccttacctctaaaatggagagaataatagaatcttccgtctaagactkctgtgagcataagccgagaaaatggaggtaaactgcttagcccaatacttggattatcgtaaatattcagtaaaactagccaccgttgttattgtaattattattttgtattttattatacatttcatggaaacttaaaagttagtgataatcacctcattttcagttgccttgctttcttcctgtaaattttattctctcttatcttgctcactgtctttaagcattgccagtttagtataattattttcccctatcctctataaaatcatatacaggatggatttgttgatctcagacatgttcactgagtttt

SEQ ID NO: 1464 - DNA, 294 bp, Homo sapiens
ggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcag

SEQ ID NO: 1465 - DNA, 249 bp, Homo sapiens
gtgcaggtcttcagccgtgacccggtaccccagctctaagggaggtggcagcatcaaaggctcccctcgcctgcgtggcagcaggggaatcttgcgtctacggggcctagagtcatgggatctgggggagccacccctgggggcaagtgtctgccctggtgctgtacctgccttgttttcacagcggtgacccgaagagacagcctgaggtccgtcctcactcactgtgtttgaggaactgtgggccag

SEQ ID NO: 1466 - DNA, 203 bp, Homo sapiens
cctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctatttt

SEQ ID NO: 1467 - DNA, 223 bp, Homo sapiens
ctgtcagaacaggaacgacctgggttatggaagcccagaaagggaggaggacttcttttggtcccagtgaaagatgcttccagaatctgtagccttacttatttgcttggatctcactggaataacttggtggtgaggtcaccggttctggggtgatcactgggtttgctgcatagatgtttggatagatgacactcacattgcttgattgacagcagaccaa

SEQ ID NO: 1468 - DNA, 177 bp, Homo sapiens; identical to SEQ ID NO: 1326

SEQ ID NO: 1469 - DNA, 185 bp, Homo sapiens
ctgaagctgagaagtagcctatctatggargagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagctttttt

SEQ ID NO: 1470 - DNA, 482 bp, Homo sapiens
ctgaccaggagggacggttctgtggacgaggacttcgtagctgaggagccagatttctttttggtcccttcctcctggaatggaatcgtggcgctactgtggagatctgagttgatgtagcacctgcttcctcggatgtagtccgcaccccggaccagatgccgctcggtcgtgggtctggagaaccggtatgggggagaggagctctcttcaatgatcggaggaatccgctcgttactgaaataccggcaaagggcatcctcccctttcctgccatgacctcgaggtctggcaaaagggtccacaatccccatccagttcccatcagcaggcatggacaaaggccgtggcttgccttcagagggacgagaaagaaggtgacaagtttgatgagttctggaactttagtgaaccgttccctttatgtataacttagacctcacaataccacacccacttagacagaagcaataacaaatttt

SEQ ID NO: 1471 - DNA, 257 bp, Homo sapiens
tgtgtgaacttagactkwtcaattcaacatttttaacrtatkaaatactattgtgaattcaatgaagtgttcttatgccactaactttaacctattcccttactcamggatgtaggyaaargatggtaacaatacactattkggcaagataatgtmctgacatmtytagcaatsttttttgmcagtggcttkcaactgmamwkaaskkammkaatattgytkctgtwsgtarattattattctgwywytaatcattt

SEQ ID NO: 1472 - DNA, 342 bp, Homo sapiens
cttttgcgagcctctgccgcagcagctccgttttcacgcgcatctcgtttttgtgtgtgtgtttttgttttgtttttgtttttgtttttttgtttcagagaattggaagctaaagctaccaaagacgtagaaagaaatcttagcaggtaagatgggcgagctttccgtctcccgccccacgataatcgtatatttctactccgattcgccctttctgggttgagaagttcccccgtgacattttcttccgcacccggagagcagacattcgggagaagcggcctgggggaatactggagggattgcggggagatgcgtaattacgcgtgtgtttctttcttt

SEQ ID NO: 1473 - DNA, 526 bp, Homo sapiens
  misc_feature 435, 442, 454, 462, 476, 524: n = A,T,C or G
ctgctacatgtcttcacagcccaggaattcaaggcccaggtggcagcaggaagaaacagtggaaaagcaaggggaagagaaaagagaaaaaggagggggaaagtctgcataactgtcataacctctgcttctcctgctctgtaacaaacccacaaccaggaagagtcatggtctggaacaatcatgggaccccaaacgcctgtaggttttttaccaccaaacatcacccatggctgctctaagctgtcattttgttcccacagttacctagcatcacggatgcccaatttatggcccaggaaggctgacccaggctaagggcagtctcactccacagccatgcaatggacagtctgaatgtttcctaccccagacctttactgacctctactatttcctcctctgatataaaagaaaaacacttttaattttctnctgcatnctacatctcctnctaaaaantttggcctaattgncatcaaaaccttgtaggaatctgaaattttggttcttctgaatcttancc

SEQ ID NO: 1474 - DNA, 187 bp, Homo sapiens
aaacttgtttgctgtgaacaattgtcgaaaagagtcttccaattaatgctttttatatctaggctacctgttggttagattcaaggccccgagctgttaccattcacaataaaagcttaaacacattgtccaaaaaaaaaaaaaaaaaaagccccykcccsgggggscckttmaaggggraawtccc

SEQ ID NO: 1475 - DNA, 474 bp, Homo sapiens
ccattctctttatctcaaaccgaagaaagatatgatgcaggcagtagttttttcttagtgcctcatagtatctaatagcagaaagtgagccgcatagcggagcacattagtttttatgtatctacaggacagaagggccacttagctgatggctccaggtttcctttgatataatctaatgttcctatgacctcaaagactgaacacatttccctaagtgcttcacttagcacccaggagcaacttggagtcttcgcagaataaaatccattattttaatgtagattaatacatgggtacttatatctatgcaggtctataatagtttattcctatgtaagctttattaaaagcattggtatgttttacataaaaagttaatgtgaatattagaaaaaaaggacaatattaaagcagtttgtagaatttgttccccccccaaaatgaatgaaatacacaatagatgtacaaaaa

SEQ ID NO: 1476 - DNA, 401 bp, Homo sapiens
ccttggggacagggcaggaggacgcacacctcatggacagggcggccagggctgagataccagcggggtgggtattcccggcgggtgcttacctccaacagtgtcttgtcagcaaaggccatgatgccctcaaagatgatgacgtttgcaccatacagtgttttctgtgaagaaacccaggagttgcggagcctggctcatgtgcctgcagccccccgaggccccctctgcagggccctggcctacccagtccttcttccggctgtgcgtggtgaagtcataaatgggcaccttgacactcttcccctgcttcagcttcttgagggtggaaatgatgaaggtcgaagtcaaaaggcatctggggtgggtcgaaagtttgaaagtttgcttgtggtgccggg

SEQ ID NO: 1477 - DNA, 753 bp, Homo sapiens
  misc_feature 59, 75, 152, 194, 200, 203, 205, 674, 682, 709, 737, 746: n = A,T,C or G
cagcatgcttaaaaagttggaggaattggaacagaaatacacctwmcaacctkrmcctnttaccaaaaacaaacnagtggtatkggamccsacctttmrkctttttcmacmacttatttcaaagytsrttkgtggkgaaaagmcacycyksnatscywccrcacccttgwaggcygttggacttrataacakknctgctnatnwntgtgaggggtgataytgatgrtgaaattgcacttagctgggttataattkgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggccggaacccaggaacctgtccttcttcctgactcccccttgtgcacgatgggctcancttttcanaagtgcttgagttggcagtttttcttnttgtcacccaaaagaaggtctcaatggngggacccanaaccttt

SEQ ID NO: 1478 - DNA, 421 bp, Homo sapiens
  misc_feature 399: n = A,T,C or G
aaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaaccaanaaaaaaaaagaaaaaaaaaaaa

SEQ ID NO: 1479 - DNA, 214 bp, Homo sapiens
ggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttccttttt

SEQ ID NO: 1480 - DNA, 434 bp, Homo sapiens
ggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaa

SEQ ID NO: 1481 - DNA, 131 bp, Homo sapiens; identical to SEQ ID NO: 1366

SEQ ID NO: 1482 - DNA, 324 bp, Homo sapiens
tgctcgctcctcagaggctgaaaacatgagaagctaggtgtggtgaaaccaaagcagctttattgttcaaatgctaaagacgggaggatggactggctcaagccttaaagaaaccatctcgactttttgaactcagtgaacgggtttaaggaaaacgtgggaaatatgcaaaggtggtgcaggagggtgcaggtctgtgtgtcttattcccatggatatcttgagtaatcgcttgtccagaggtggggtttgtgtcatcctgaattcaacccagcaatggtagggtactgttcataactcaccctaagccagaagattcctcag

SEQ ID NO: 1483 - DNA, 393 bp, Homo sapiens
atgtttaatgaatgatacaggatacatccctgttggaagcttgcaaaagacacatacactgtggtacatatttgatttaatagaagttgtttatcaggctatatatatatttgcccaaacatgcaccacaggataaaataactatttacataacatagggtatttaattgacatagactatcagctttgctgagagcagaagatggcaaagcaatactgcagcagaaagtggaacaactattctaaagcaatactttagatatatttttctagaatggatttattagattactttttggaaagcatttgacctaaattaaatatagagctctgaaacttagaataaaatttgcacttgctgaaacagaatactttgcataaaaataatccttt

SEQ ID NO: 1484 - DNA, 323 bp, Homo sapiens
tttagatcagaaagtttgaggtcttcatcagcagacactcgtgcttctatttttcttgttttatcgaacagttctgaaactttgagaaaaaacttgcatatatctgtagaatcctgagttcctaaagcatataatgaagaaccaattctattgtaatcatctgcagcacttttgtgggatcttgtcattctatcagatttagcagatgcatccttaactcggttatgatattccaaaagaaatgttcgttcgtgctcaaagaaatcatctacatcctttactcctgaaacgattactccatctgctgatttaaccatgttttt

SEQ ID NO: 1485 - DNA, 405 bp, Homo sapiens
aggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctgaaggaggagcgattgcagcccatggagagcaactacacggtgctgattgggggctgcgggcgggttggctacctgaagaagg

SEQ ID NO: 1486 - DNA, 230 bp, Homo sapiens
aaaaatatgtggattgtgcttgacgtagcaaatttcttctatctgcaaaagcccttttctcactacctcatatacacccctttgatatggcaccatgtttgaaattggagcgtacacacatagtcattggatttactgggattctctttgtgacaagtaggagccaaggggtcatgcagggaagcgaacgtgcccgataaggatttccttgttgccagagtgtttagcag

SEQ ID NO: 1487 - DNA, 273 bp, Homo sapiens; identical to SEQ ID NO: 1424

SEQ ID NO: 1488 - DNA, 452 bp, Homo sapiens
cctactgtgccccgtaggcaaagctctgaagatttcatcgaaaaatctgctgtcaatacgtagaaaagttcactatttcagtttcacagcaaaaaaggtggggggaggggggaacccaatagatatttaagtagatgctttccaatcccattcactgcattaattagcttacctcttatacagtacaacataaacattgcatgtttatttgtatgtaacacctataagcatatagcatctacattttaagtgtatttacaaattcaacaaaatatctacatataaaaagctttacttaaaattaaacttgatgcaagttatgagaaaccaatttattggcaaatgaaactgagcattccttcaaccataggttgttatagattttcatatttggaggtaacccatttgatagatattgtttatgaatacgatagaatatatatttacttttt

SEQ ID NO: 1489 - DNA, 653 bp, Homo sapiens
  misc_feature 556, 562, 568, 573, 589, 592, 632, 637, 645: n = A,T,C or G
cctgctcttctcttcaaagcacttagtacacagggktacaggtgctaccacttggattccccagagcatggaagtctgatcccaggttgaacatatttcttctgaaaatgagcatcttggttctatagattcttatcttgctcacaggacttgctccaaaactgaattttcagaagcagcatgatagggaaagagatattcaactctgacagacaaggtagatcgaagcacccacactaatttctttcaggtgccccatgaggaagactgcatcatgtcacttccactcacttggggagattctaggactgagacacaaagttcccccagagtttctgctaatggaaggggaaacaggtggtttggaatggaaaggtggaaccaggtccacaaaatgtgctccctctgctcaagactgactttggctttcccaggtccccacttgactttcatataagctgagatgacctattacgggaaaaattagggaacacctaataaaaccaactttcaaaaactcctatttatcatggatgtgccacgatcgagagaatcnaacacnaactgnctgtnagagaggccttcattntgnctcatcttgagctaaaatcctgrcttgggatgccagaaancatgnccctcttntcggtttg

SEQ ID NO: 1490 - DNA, 363 bp, Homo sapiens
  misc_feature 347: n = A,T,C or G
taacctgacaaaataaaacttagtaaaatctakaactgtttcttggcctacttgagaggaacttccatattttcacagccatctccgaaagcagcagttgctgtaaattaactgagacttggaaatggtgcagactgtcttggtagagctgttcttatagcacaattttatctggaaaataaacttgtaaatgcgtgctgtatattaatacatgtgtgcccatatttatttttattatctcctgccagtctttgctcaatgggagatgacagaccaacttctcaacgtgatttccccatttcattgaatgagatttatatgccacttatgaaaaaaaatactgctgngaaagaaatgtacttt

SEQ ID NO: 1491 - DNA, 163 bp, Homo sapiens
taatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagtttt

SEQ ID NO: 1492 - DNA, 184 bp, Homo sapiens
yattccccaggggaaaaattgaaagtcaaactattcaccaagagaatgcattgtctttgcaaatgagcctaagaatcagactttttataaatacatgttcaagtttcttgtggttctaaatggacactgagaactgaaactgtctacaccaagtttacaatctatattaactatcattwtacag

SEQ ID NO: 1493 - DNA, 273 bp, Homo sapiens
  misc_feature 39: n = A,T,C or G
aggtaawttgtgatatttagtgcacatttacgtgtaggnccrtcttkaatggtaaagacagatacaagcctatggcacacttctccaaagcaagctatacttgagagccaattcccaaataagacagcagagatctgattaaatgcaactgtgcaaacattcaacagacatgttgaatgtaagacaaattatgattactgataatatgcaaatgtggtctataaatttatgaatgtgacttccaaggggaatatggtatggaagcccattttt

SEQ ID NO: 1494 - DNA, 343 bp, Homo sapiens
ttggaaagcctatcactttctctcttcattctccagcccccacaccaagcacacagagcttttcagtgctttactcttaatggagaacataaccagggattatcaggtattccaacatgaaaaagaaagtccaatagaaacaagcaggataatcaaaccaggaggaagcagagactatatagagaaagaaaaaaagacacatgggaataacggcaataatactgacaatacacctcaccataaacttatcagaatgaatttgttggagaaatatatggaggggaggtacttgtgtgtgtgcacaggcactcatgtacacgtgtgtatgtgtatgtttttttaa

SEQ ID NO: 1495 - DNA, 378 bp, Homo sapiens
tagcattcttccagccactctggcgtcactatgtgcttcacgacagaaatcgccgtcaggaacttcacggtgcgagtcactttgctggcaatgaggtgtgtgcacttctgtgcagactccgcaacctctccaccaagaatgtagagcttcttaatatactgttgaacctggacaggctcgaatccagtgaaaagcacaaaaggggtcaattctggagttagctttttagtgggaggtggtacgtcttcaattctggctcttttggaagaaggctggacattagctacttcattctgtttcagtttgggaggtagtcttatactcatcaacaactctgcagacacttttaagggaactctccaagcatctaaaagattt

SEQ ID NO: 1496 - DNA, 181 bp, Homo sapiens
tggagaaggaagttttcctgaagagccagaatccttgctaagtcatttagatccaactgaccatctttatttctgtcaaaaatcttcatcatggtgccagtgtattcttccagtttagcctcagaaatggcctttttgtggtgaagaaagaggtctcggaggaagttgcggagctcagcag

SEQ ID NO: 1497 - DNA, 373 bp, Homo sapiens
tggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatgg

SEQ ID NO: 1498 - DNA, 337 bp, Homo sapiens
gctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatgg

SEQ ID NO: 1499 - DNA, 314 bp, Homo sapiens
catgcggagggactttagcatggctgataaggtccttcctaccattccaaaagaacagaggaccagagttgcacactttttggaaaggcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttgg

SEQ ID NO: 1500 - DNA, 321 bp, Homo sapiens
cctgaaacctggtgggaagatgattgaaagtgttttagattcaacagattgactatgtatgacttatctattaaaatgaagaacttccatggtttaatagaatgaatgctgtattcaacaaggtcttccatccttcttataaatcttaagactgtgtttaagctttctttcacttttactctatcccttggaagttaattgggaataaaaagatttatcaatttagtcactataatttaaggccaggcatctgcttggaaatacaataaccacaattaatacttagagaaaattgtttcaacagattaactctgctatttt

SEQ ID NO: 1501 - DNA, 557 bp, Homo sapiens
ctgctctggggaaaatggtggaggagccaggcagagaggaggagcagagtgctggcagtggaaagcctagctgagactggagatgcccccctgcccaaagcatctcagcgaggatgcttctccatatgggtgagccagcctagagacagaacaggggaagccagcgggtgctgcagcgacccaccgccccagaacatctgcatcttacatcaacaaaggtttatttctcattaatatccattgtgggttggctgccactctaaccctcgttgcctctccatctgggtcttgggtggcagagcagcctgtctctgtggcagaggaaaagagagcactgggcagcacaggctgactctcaaattttccgcctgaaggtgacccaagtcactgctcacatttcattgactaaagcaaaatcctatgcctgtgggtgagttgagcaacgtgatgaggtgttaacttcctacagggaggggctcaaatattgcccaacagtggtatggcccactgcctggggtggtcggtggaaggctggcaggacaagggagaccacgtgg

SEQ ID NO: 1502 - DNA, 249 bp, Homo sapiens
cctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtgg

SEQ ID NO: 1503 - DNA, 302 bp, Homo sapiens
ccaggacctcttttgggcatttcttcctaagtggaatacacaacagataagggagtaggggaggtaatacagggaagctactctttccagctcagaaggagttgatgaagcccatatatgcattcaagaagcccatgggatcctctagctgtggatagtggctaatgtggtcatccagaatcgacactgtggaccgcggcagcgttttcctgtacagctccaaaaactctggatagggatttacaggatccaatggcccatagataaaatgaatggggatagttacagaggcaagagctccc

SEQ ID NO: 1504 - DNA, 430 bp, Homo sapiens
ccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattgg

SEQ ID NO: 1505 - DNA, 164 bp, Homo sapiens
ccagtcaccttcaccttctaactaactagcctccggatgaggtggctgccaccaggcccgaatgatccccaggagcccagcttccaaaccccaacatcgaatcaaacatctccatccccaagtgcagtaacacacaaaaaccaaacactctgccctgggaaagg

SEQ ID NO: 1506 - DNA, 189 bp, Homo sapiens; identical to SEQ ID NO: 1413

SEQ ID NO: 1507 - DNA, 268 bp, Homo sapiens
ctgcacagaggggcacggaactccaaatcctggaatgcgggtcaataatgtgaattctggccctgaccgccagacacacagcaagcctgagtcatctgccgtcaccatgtcagccacacaatcctgtccctgggcaggctcggtggcaatgtctgtgattggcatctggtgcccagccagctcctcgctcagtacaatgttgggaccctttgctgggatgtcaaacaccagcacccggcctgaccacgttcccacacagatgaagtgg

SEQ ID NO: 1508 - DNA, 159 bp, Homo sapiens; identical to SEQ ID NO: 1342

SEQ ID NO: 1509 - DNA, 234 bp, Homo sapiens
ccattgtggagtacattatgaacacaatgtgcttgykaagtcttctctctcattttcagacagcaattgttaagagtcacacacacgtcccagacctaagcagcaactccagtgaatggtactcagacacactcacgggacagcacagaacttgattcttctttgtctgttgcccaaagaacctgttctttgagtctgttccaggtgacttgtaatgatacctcttacggtttt

SEQ ID NO: 1510 - DNA, 437 bp, Homo sapiens
aaagcagtacatcttaatatgaagacaggaatttctatgatgcttacgaacattagactcaacatttttgcagccccctttcctggtctacattcacacaaacatgagacacagtcccaagggagaaacagatgctggaggagcatttagggccagagtggaggcacagaggaagctgggatttttcaactaccccctccttggttactcctgggattcccttaggatttcacggcacaaccagcgaagagtttgctcagattcacttcggagtagccacttcgggacaagaattgctctgctgtgttcttgagttttctgtagtcctgcagaactttgggggtaaaaaattgcttcttcaatttatctttctcatgatcggtagtaagtttctccagtgcacactccgcatcaaaaatgtaccggtaaaagcacag

SEQ ID NO: 1511 - DNA, 94 bp, Homo sapiens
tgtgaagatggagtctgaggggggtgcagatgactctgctgaggagggggacctactggatgatgatgataatgaagatcggggggatgaccag

SEQ ID NO: 1512 - DNA, 493 bp, Homo sapiens
aaaaatatgcattacaactggagttttccactgagaataagagtttggttttgacctcmcataaatccaagggttcttgaaaaaaaagttaatataaattctcaataactatatcattaataccttatgtatacataggagtttatataatgcatttaagtaacaaagaatgtaacatttattagccaccaagtaattaggagatagcatcaattatattgaaagaagatgagtttagatgcttatagtcaagggagttaattgaaattgaaagctattgtaggtggttactactattattatcaaacctgaaagttggaacatgtgaacttgatcctttgcacacataaaagttcacaaagctgcttttaatttgcctttgttctgtagtactgcttggtgaatcatgcactagtttgttgtaaaattcatgtaaacttttatgtatacaaatgtcagatcaagcacaggttttattaattatatatatttt

SEQ ID NO: 1513 - DNA, 510 bp, Homo sapiens
aaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcagagccacattatttctagtccaaaattacaagtaatcaagggtcattatgggttaggcattaatgtttctatctgattttgtgcaaaagcttcaaattaaaacag

SEQ ID NO: 1514 - DNA, 511 bp, Homo sapiens
  misc_feature 472: n = A,T,C or G
ctggagatcaggaatagaacctttccaagatatcataatattttctttataggaacactgagtaatggcaagaatattttgagcttttccatggttaagagcgatagtctcagaggctggagaaaatgttcattctgctcagtgatccaggagtgtgaggacagtagcttcctttccacgtccacaagacaatgacagatgtgtttccttctttgccctttctagggatctttctagggatgttgattctctcacaatatttcaatgtcccatttctgtgtttcttctccctccaggggctgatttacgattacatgagtcttgtcacaataatttcctcctttaacatcaaggacaagttgatcactgagataagagctgatagttccatttttattcagtctccacttctgcctgaattgcccatgttcagtccatagagctactttagctccaggtgtggtcccggccnccatcacatcaagaactggtttcactgggccttggatta

SEQ ID NO: 1515 - DNA, 176 bp, Homo sapiens
aaaggggaaggkgaracttaaaagtattcccaactagattatctacaccaatacattggaactctatattttgctttcattttgtcttaaaaaaatgaaatagcaacgctctatcagtcacacagaggacatgcaratttagcagtattgatattatactctatcttgttggattt

SEQ ID NO: 1516 - DNA, 309 bp, Homo sapiens
ctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacaccgtgtactccctgcagcagttcgggttttcagagaaagatgctgatgaggtgaaaggaatttttgtagataccaacttatacttcctggcgctgaccttctttgtcgcagcgttccatcttctctttgatttcctggccttt

SEQ ID NO: 1517 - DNA, 182 bp, Homo sapiens
ccaacatctaatttttttactttttaattatagctgttgtgactgatgtgagatggcatcttactgtggtttttgcttgcatttatttatttgatgattagtaaggatgagtgttttttcatatacttgagtgtcttcttttgagaaaatatctgttcatgtcctttgccttttcttgattt

SEQ ID NO: 1518 - DNA, 548 bp, Homo sapiens
cctgagggagagggaaaagcggatacccacctgtgtcgctgtttgcgtgccaagtccaggaacagtccatacagccctgctgcatcccacgacgctgtcacaaagcaggagttcatccgaggccaaggtgttgtcatgagaatattcgttaaagtagggacgctgactttgttcttgggcagattctcttcctgtggagtatccagcctgtttgcctagttttcctgttcttctggggtctgatctctatctgttttactgcagtccagttaccaaagtggtataagtaaaattgaaagaattctaaataccttttccccccacgttagctgcctcacgttaatgtggtcttacggtctgcaaataagtgttttgatgatttggcgactgcagttacccatactagctctcctaccactcactactgacagttaattattatcgaatatccacccacccagggtgagttataagttataccaggtgttttggttaataatactaatgcaattaatttactggttactctctcatcttaaagtaatcag

SEQ ID NO: 1519 - DNA, 491 bp, Homo sapiens
ctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctacttgtcctcggactacgagaggtcagagtgggagagaagcaatttcagaaactacagaagaaaggatcttcagg

SEQ ID NO: 1520 - DNA, 169 bp, Homo sapiens
ctggtactgtcgatttggaaagctggctggaaaaaacttattcatgaaggggctgatggtgtgggacagggccaggattcccagcacgaagaaatacatggacagcaggaggttgatgtactcctgggagaatattttgaaaaagaggtagagccccaagagtgtgcag

SEQ ID NO: 1521 - DNA, 293 bp, Homo sapiens
aggacgacgctgtcrgargcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacag

SEQ ID NO: 1522 - DNA, 386 bp, Homo sapiens
ccacgtgggactttgaagacagcacaacacagtccttccgctggcatccgctccgggccaaggcggagaaatacgaagacagcgttcctcagagtaatggagagctcacagtccgggctaagctggttctcccttcacggcccagaaaactccaagaggctcaagaagggacagatcagccatcacttcatggtcaactttgtttggtagtgctaggagccaagaatttacctgtgcggccagatggcaccttgaactcatttgttaagggctgtctcactctgccagaccaacaaaaactgagactgaagtcgccagtcctgaggaagcaggcttgcccccagtggaaacactcatttgtcttcagtggcgtaaccccagctcag

SEQ ID NO: 1523 - DNA, 178 bp, Homo sapiens
aaaaagcctatcccatactgaattgtgggaacctatgaagtgtctcttaatgtcaattaaaagtaacagtggctgcagatattgatttctgaaagtacatgagaatttgtctctaactatggttgaaacaacaaaaccaaatctgaatcaggtagaggtctaccagacacaaactctg

SEQ ID NO: 1524 - DNA, 319 bp, Homo sapiens
wycacagcwgaaatggggcactgaagtgtggagscacakaatgcgggagggcagaaccacagacaggaggctgagattgacctcctgagtgcaagctggtctccccttcacctcctgcaccctacgcagatggtgcttaccataggattgccgtaaaacagagacacgcaccagcgagaaactttagcccttagtatcccatcctcaggacagaatcactcttaaacatgttgaaatacatctgcttagagcttttctatgtgtctatataatgtatgcataatatacaattagaagcatgtgattttataacattttt

SEQ ID NO: 1525 - DNA, 467 bp, Homo sapiens
ccagactagacagagatcaggtcatcaggggagcttccgagcttcagcaaagcccacaggtagctctgcgaactcagaatgctaccctaccttccctgcaggccgctgttcatgtctggactcctgggggcgctatttaatgtttacccccatctccagtgccccctccaaggctgtgcagtgtcttggggctctcagggccaacatcgaagagatgggggccacctcttaacacctggcaacagtctcccctcatcctgattcctgacaacagacaaaacaccggtttctagggtttatctgtttgttttttgagttgagggttcctcagggccttggcattgctagtgatggtcccctttgctgtgtgagaaccccctcaaccccttcctcctccctctggggatgaagtgggagtatttggctccccatttttgacaaaagggctcagtgcagggaggtggagg

SEQ ID NO: 1526 - DNA, 439 bp, Homo sapiens
aaactgtttactggagaaaatcctcgctcatgtccatttattgtttttttctgtactgtgatttgtttcaagcttaggaaaactagtatattagagtatgttctaggaaattaaaagatctggttagagtaaaaagttctttttaaggttcttaactaattttttcacaactaagaaaataaatgaagtattcttaggctgaaattcatcttattttatcataaattagattgtaggggcagcctacatttttgtgtatgtgtttttatttcttaaatgattgtgtgagcctggtgacattttatggttcttgtgatctaaactgtttttccaattcacatcttttgtcgtgaagtgatattatactagagtactgtttgcattgtaaaaatgctttgctggtgctctggcattttgtctttatctcatcacctaattt

SEQ ID NO: 1527 - DNA, 609 bp, Homo sapiens
  misc_feature 582: n = A,T,C or G
ctggagaacttgggctccattaggtgcaatcgttggagtaattagcccatcttttacatttcttgccacaaaatctcgaagagctgccatttcaggttcggacagtgaatacacatgtccactgggaatactgtgtgctccaggtatcatttctatgtgagggtcaaccaggcggtgatctgggtagacgtgctcatctactggagtgtacacattctggacatagtaatacctcactggttggtaaactctgtatccatctactggataatagagtggcggttgtggtgctggtggtgggagcgatggtggtattggagaatacatccggcagtggtagcggcagtattcagaatcaaagacgatagatcgagtgctccatgtgatattgggatcatgtgtgctcagccagcgaacccctaggacgacagggaagaatggagactgagtcacatcaaatgacagcacctctcggtgatctcccaggtcaactatcaggtcgtgagtttcgtggacaactgggcccgatgctatggggcgcccatcaattgcttccacaagtattggacccgcccgggcggncgctcgcaagggccgaaattccagcac

SEQ ID NO: 1528 - DNA, 393 bp, Homo sapiens
tgatgtaatgaattcatatttattgatacagaaaaatatgatataatccatctaaaaagcaagttacaaaacagtgtacagtgtaccatagtacctatgaacacaattagtgaagtaatttgcagagctataataccaaatcagaaattattttggtaatgaatttatgattttcctcgttttctgattttttccatgatctcatatactttattctcagaaaacaaaagacaaaaccccacacatacacaaaaataaacgagtaacttctttacaaccccagaggctaagtcagtgggaaaagagggaaatgaatggttatgagcataaacacagggacaaataaaagaagtttggagcacagagaacaattcacaaatcagaagtcatttt

SEQ ID NO: 1529 - DNA, 143 bp, Homo sapiens
atccgatagaatccagttcaatgaccttcagtctttactctgtgcaactcttcagaatgttcttcggaaagtgcaacatcaagatgctttgcagatctctgatgtggttatggcctccctgttaaggatgttccaaagcacag

SEQ ID NO: 1530 - DNA, 636 bp, Homo sapiens
  misc_feature 330, 504, 583, 591, 625: n = A,T,C or G
gtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggnttgtacaaaatctttgatgagattctagttaatgctgcggacaacaaacaaagggacccaaaaatgtcttgtattagagtccaattgatccggaaaacaatttaattagtatatggaataatggaaaaggtattcctgttgttgaacacaaagctgaaaagatgtatgtcccmnctctcatatttggacagctcctaacttctagtaactatgatgatgatgaaaagaaagggacaggtggtcsaaatggctnttgagccnaattgtgtaacatattcagtacccaatttactgngggaaacagcc

SEQ ID NO: 1531 - DNA, 194 bp, Homo sapiens
aaaaggcagagcattcttttttcggcaattttgataagcaaggtgtagatttacatttttgtccttgctcccaacgaaatggataaacaaaaataacttaccatctactcatggaatgttgttgtgttagccagtctgaaggcccaccttaatttttatataactgtctttagctcttcttttgacagggcagg

SEQ ID NO: 1532 - DNA, 300 bp, Homo sapiens
ccatacaaggtaattttgacaggttcctgggattaggacatgggcatcttgggaggccactactggcctaccacaactgggcagcaaaactattacaccctccggtataatagttttggtgtttcaatgactgggaggaaaagggttggaattttttgctttggggtccctcttaaccttgtatttttaaggtctgggactcaccaaccctccccttccaaccagagaaactcactgcagtatctccttgaaagtctggtgacgagtctgtctaagtgctggtgagaggcacaggaccaa

SEQ ID NO: 1533 - DNA, 521 bp, Homo sapiens
gttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagatgtctccccatccccattcggggctgacgatggggggctgatggctgcccctgcgtggcctgagtcctggtccctctgaggcagttgacggggcagtcagattttt

SEQ ID NO: 1534 - DNA, 181 bp, Homo sapiens
actcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcag

SEQ ID NO: 1535 - DNA, 544 bp, Homo sapiens
aaaataggacactaaatcctactctgaaaggtggtttgatcaggactaaagagaatgtatgtagagtgctttgtgcaacgaattgtggggagcttggacccaataaggtagccagaattacccacaccatcatcatcttcaccaccatcattattgttatcgacatattccaatacacttctgaagggctggaagagagaaatatgtttgtgcagacaggcggcagcagtatttgatccaccaccacagctccaccgcttgggggcagtactgatccacctgtgctcccctccctgccccagcctggaaagctaatttcagactcaaaaaaatcaagtacagagcagcgcacccactccaatgagtcatccccgcccactctagacaacagcatgctcatgactcaaactatcttcgtgaatggttcaaaatatcaagaattggtttccatagtttcttgactaaccagacacaaaatttcccctacatgcagagattcatgtctcaacttcaactgtacattaaactcaaccgggaaactttt

SEQ ID NO: 1536 - DNA, 591 bp, Homo sapiens
ctgagttaagatggtaaagccaatattattttaggaggaaagaggacgaaggccaatgaaccaacatctgcctgctatctggtgcatcacccaaggtgaccaatggctgggcacaaataaacttctcttttgctagccacagagttgctcactgtggcaagcctgagctggtcagaacacctgtgtgtgtgttcctgatacacactaaccacaataagcaagtctgcacacatctctatgagccccatgcaaagacaagacattcccaaagatcagtcactagagtgcaacaacgaaattcaagatttgaccaaaacagaccctgctgcctcctaaattgccaattgcctctcaaaaacttacagaaaaagggacattataagaattcatagagggagagaagaaaaagctgctactcctagtcattagtacaatgtgctgtgttaattagatacctctatataaattagaaaaagtgctttacttgcatgcttcaataaaatgaatactgagtgtcgtagtgttagatctgtacagatataaattttttgcagctatataaaagtgtataagatgggcttttgccatttt

SEQ ID NO: 1537 - DNA, 341 bp, Homo sapiens
acttcgggcctccctctccctgtgcagaccggttgaataaatgataaaattactgtttgtgtcctctgtgaagtctggattaatggaaaaaaggatttgtgaggctagtcttaggctgtagccaatctggtgtgctttttgtgtcttcctgtatggttccatgataaggaggaataccttaggatagaatgcaagcctaggaccccataagcctgttgttcaagccaaccagcaaactgggcagtaacaaacattgctgcaggtttccattttgttttacgtccttgggagcttgaccttgtaaccacgtggcagtaccttcttttggcctctgccatttt

SEQ ID NO: 1538 - DNA, 363 bp, Homo sapiens
ggacctgactttgagtccatcagagacaaagtgagtgagatgcacatacagtgtttccagacctgactcagcccatctgtctgttaggaaactttatgaagacgccccccagaattaaaccctaattcaaatgtctcactctgaatagagaccttctgaaataatcttggtatagagacccagacacgtgccttttgccttaaaataaaaatatttagcccatgttgttttatgtatctgtctttcagttagttttgaaggcccgcacggaaaagtggggcctgtgcacctgaaaagaaatgtgtatgttatgtggttgttggtctttcctactagagttatcttgataattgtgaagagtgg

SEQ ID NO: 1539 - DNA, 371 bp, Homo sapiens
ctgtgggggtccttccagagaggagctgagatacgcctacctggaggggcccctgggcctggaggggctcctcagtgtgactgggtgaagtgttttcagaggaccagggttgaggttgggggcatctcatccagaccctgccggcatctgccccagaacccaagggcccctccttcctccctcctcaatggaaatgctggagatgtcctcagtcaccctctgagcactcacacatcaccccttatttggaaatttttctcactctaaccttccttcctgctgcaccttctgccccatccccaggctctggcctctctctctcctcttctaccctttagcaggtaatgactcagttcccactgaggagccag

SEQ ID NO: 1540 - DNA, 403 bp, Homo sapiens
ctkgacgtgatggagcaggtgagcagtgcccgtggggcttgccagagggctgaggaggaccctctctaaccagctccctgtcccccttcttctgtagcttgagttgaagaagacactgctggacaggatggttcacctgctgagtcgaggttatgtacttcctgttgtcagttacatccgaaagtgtctggagaagctggacactgacatttcactcattcgctattttgtcactgaggtcagcaatgcaccgttggtttcatgtttcatactgtttacactagcactgccctttttggcttaatttagttcattttgtacctaactgagaactgtgctttctgatgtagtgatgacaatgacagatactcgtttaccaaaaagcaccttctgcctgcagcag

SEQ ID NO: 1541 - DNA, 428 bp, Homo sapiens
taaaacaaaactaaagaagagaaaatatattctcgtaaattatctgaacttaaaagatggaagcctggagatagatttgtgataagccattgctgagtacatcctagagttcttgataatttcagttggttaaattacaatagtttgctatttcctccctcacattttatgttctacagtatctagctgcttgggttttcctgtataccatggggcttctgtcatctgggctttactcagtggcatattccctctgcctaaaactctcctcccctctccaccttagaagtagcttttcctagaacggttttcccagggtttcacctaaggtgatagtacaatctacagggacctgcacatgaagacctttgcatacatgccaggaagttggactttatctttggaaaaagggagcctttgaaggtttt

SEQ ID NO: 1542 - DNA, 345 bp, Homo sapiens
awttaaatgcttagcaagcagcaattccacgatggtcaaattcctaatatgagagaagtagaaataggaaaaataggtcaccctgatacttatgttttcattttgcttaatatacgtttgtatatttcaatataacattaatagatatcgtgtcccttcacagttctaaagtagtaagcaaaatgaattaatttaacctatgcaattaaaaccaatttggaagaatattgaggtagcacactgttacgggaattagtatgactcagtaatgcagttgaaagttagtggctcctaatccagtatgaatcatggagatgagagaaatgattagataaagagatattt

SEQ ID NO: 1543 - DNA, 420 bp, Homo sapiens
aatattgaatttctagaagcagtatattgcttactgcttcttaattacgttatagatgaggtggaaatgataaaaactaaagaagcaagattaatctttaacacacatttcaggctgttgtaaaagaataaacaatgcttcatataaacttctagcaaatgacttcctaatgaggtcttgaaacagtctttagggcacggaatgtcatcacataattaagcagctttaagcctttattaaaaggcttaaagtcgcaaacaatgaaatctgaaacaaactgtaccatattaaactttttgatgatatttcaaattcagtaaaagaaaaaaaggatggttcagaataacatcacgtattctaatcctgaaacacataacaaatgcatctgaaacagcaattcttaaaaaggttttgcccttt

SEQ ID NO: 1544 - DNA, 306 bp, Homo sapiens
ctggcttcactcctactccctctctgctcgcagcacgtcggccgccagctctttgatgtgttcccaggcccgctgcacatgggcagattccaccgtgcgagaacagatggcaaagcgcaggacaaacttgtccctgaggtgacatggaaccaagtggatttttttggcactgtttattctttgcagaagagcttcattcactttgttggaaccctttagccgaaagcagacaagccccagaatgacttccacacagatttcaaagcggggatcctggcgcaccagtgactcaaactcatgggacag

SEQ ID NO: 1545 - DNA, 110 bp, Homo sapiens
ctgctccgggccttcatcctgaagatcagcgtgtgcgatgccgtcctggaccacaaccccccaggctgtaccttcacagtcctggtgcacacgagagaagccgccactcg

SEQ ID NO: 1546 - DNA, 239 bp, Homo sapiens
aaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaagg

SEQ ID NO: 1547 - DNA, 527 bp, Homo sapiens
aaaaattccagttgagatttttctggttctctgtataaagattgactggaacatatacattttggggtttatgtttggagactttggctcttattcaaaccttccattttagttggcttcttctgacagtgcttcagcatggaagcaaggagggggcctcattactgccaggtaagggtaaaaatctagtttctctgctgggtctccattgtcactaagaaaggaatggctctgttattgctgggcagggttggctgttccaactgataatcctatgtctgggagggctaggagtgcctccttgctgttcctcttgttgtttccactgacagtggagtggccttgttactgctgggtggtggttgagagttctggctctctactagggaggacacaacctcagtgtagagaggcggggataccttgttactgtcaggcacaggcggaggtccagtctccttactccacctacccaacagggtagcttgaggcacttcattattgcctagtgagagtggaagtttagg

SEQ ID NO: 1548 - DNA, 333 bp, Homo sapiens
ctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcag

SEQ ID NO: 1549 - DNA, 438 bp, Homo sapiens
ttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccag

SEQ ID NO: 1550 - DNA, 204 bp, Homo sapiens
aaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagttt

SEQ ID NO: 1551 - DNA, 132 bp, Homo sapiens
ccatctgtggatttgtctgtgcacctattggctcttctagctgactcttctggttgggcttagagtctgcctgtttctgctagctccgtgtttagtccacttgggtcatcagctctgccaagctgagcctgg

SEQ ID NO: 1552 - DNA, 433 bp, Homo sapiens
ctgaatagaggtcaacacagttgcgatgttgagggatggtctccaagcaccttttggtggcaatttgagaacatccagacaaatccttccagcagaatcaatgtttggatgataaattggagtgagaaatcggatctgaggaggttcaaatgggtacctctcaggaatgataacttctagcttaaaaacacctttctcataaggtgtgttggctccacctaatatttgagctcgcaggtcatccatttggtctttatcttgccaacatgtgatgcctgggggtggctctgtggctaacatgtgcagctctctcttcagacgtgaagctctctgcatgatccccaagtagaaggaaccacacacagttcactgctccacactaagagctgsctgggatgcactgagctgacacccctcacaacgcagcaacgcg

SEQ ID NO: 1553 - DNA, 316 bp, Homo sapiens
gagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaagg

SEQ ID NO: 1554 - DNA, 542 bp, Homo sapiens
  misc_feature 517, 532: n = A,T,C or G
aaaggaattattctggcagcacatgtagtattcttggatgatcttgctgctcttatttctccttttgtgtgtgtgtgtgtgtgtgtggctatgggttttcatttgtaactccatctgcttargagagtgggctctctataagggaacctgctgtaaacttcattgcagcaaggatgtagagagaaataggacttaattccactaggggctctcatctcacaccttaaggaggagatttctagaaaaactgggccagattttctttgytctccatcattttaatgtggcaggctgytcagttttcttactcttacctatgwgatatttcttcgtaacgtgtccaaaaagaaaaaagacccaatcagtgtctcttgactttgttctttgatccctcagtttcttcttgatttcagcatgtgtccgggttcctaattttgggtatgagttagcaaatttaaccattgtgtttgtgccctacccaggggactccccagtttctgacttgaagtagactganaagaatccacgaggngctattttgg

SEQ ID NO: 1555 - DNA, 117 bp, Homo sapiens
ctgtctgtggcttcccatgtctttctccaaagttatccagagggttgtgattttgtctgcttagtatctcatcaacaaagaaatattatttgctaattaaaaagttaatcttcatgg

SEQ ID NO: 1556 - DNA, 111 bp, Homo sapiens
ctgctgcagccgcagtttctcatccggagtgtaccccgtcatgtcgccgctggtaccaacgcaaaaggacacggcgcaccctcgaactacggactagttacttaagcgcgc

SEQ ID NO: 1557 - DNA, 454 bp, Homo sapiens
cgaggactgatcctctagtactaagtgactggggatattacaytarccaacattggttgatacatacctkartmatcatwtgaggaygcagtgataarsgsatawwmywgtatsatccyaacaygyactarctcaaaaactagtgggggcggattgatctcctgtgggacwkcacatgscctgaaagtgaacatgmtcmtratcacctgcagrgcttgagatggyccmcatkgcwgcactccgccccyacaktttttgawtcwacwggagttaggswgmtyctwgawttakcctttctacctgcctccygakagrwgcwcwygastwggakgaatssattgackkctaagrttakacttccactaactctgtacgmtgarctcttactaatattcgttaccacgctaagaggctctgctccaggatctcatcgcgactggaaggaacctccagc

SEQ ID NO: 1558 - DNA, 404 bp, Homo sapiens
aaagaagtgcagttgatatctaatttacacagtgaaactagtgatagaaaataactaatgaaaaaaaatcagagactggtttccaattgattgacacctagatctgtcagcctctcttaaagaaaggggaaggagaaaaaaaatctcatcatggaaggcagacaagagtccacctgacagaggtggaatctgatggaatctgaccccatttcatgataaacgagaggaaacataaatgccatctcaaatactaaagcgatgtagtgtagcatgagtgactcaatgcaaattcacagaggaaaagaagttacggcttaggaagtaggacaataaatacaaatatttcatcttatttaatggtgcatgacttcagtgaaactaccctttgcaatgcaataaatttt

SEQ ID NO: 1559 - DNA, 266 bp, Homo sapiens
aaactatcagaagagatgagagggaattgatctacaatactagaattttatgtgcagacaaatccacatctggaaatgaaatcacagtaagatattttcgggagaccaaaacataaaaattgctagaataaatttgccacgaacgagtaactagacattagaaattgactacatagatatagtaatactaaaagtgctgaaaacaagcaaacacaacacacacattctcaattctttttttttctatcaaatatcttcaacttttt

SEQ ID NO: 1560 - DNA, 142 bp, Homo sapiens
aaaactcagtatcttctgaaccagaggcatttctgattagcccttccctacctattttcctagtatcactctttaatcagcttggggaggtggcagcatttcatggcctccgtagtaactcacaatgcttcctggggtattt

SEQ ID NO: 1561 - DNA, 381 bp, Homo sapiens
aaacactaaatgaagcttctcacaatttctaattataaacaaaaggctgaaaacagtatgggaaacaaagtttcaaaacaaagaaaagttgagtaaaaggtgccccctctatggctcatctgaaagaaacattttactcagagaggcaaacatttctgatctaggagtaagtttcccactcactttgcaaggacccactcattctgcagaaagacctacaagtctttctggtctcaattgcaaagtacgtgaaaatgtgtatgaaagatctaaaagctaaatattagaataaggctaattgaaatcaaaattgtgtgctggtctaaatatacatcttcggcttcttcctttttagtaagtatttttatttcagatgtattt

SEQ ID NO: 1562 - DNA, 368 bp, Homo sapiens
ggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcag

SEQ ID NO: 1563 - DNA, 411 bp, Homo sapiens
  misc_feature 32, 332, 333, 346, 361, 381: n = A,T,C or G
accwtrsaactgcawttattacctatgctagntttggataagaamtgkycwtayatgtgakagcaagagggcacyarawswrcttsaacaccaawgggcmktactwtatakawmcgawgggcatgctwtmatgaccaactgrmtgactgtttgagaatggacaargtgctagcgctaaacctgtccttcttgaacrtggcttgactaacgkcwttgatacgttrccttcakkasaatactattactasactttgktgcttgattaccgactggtgcactcttgmtctcacctatgargacagtgctttacacaaactcrtakggaaaattgnntttgtmctgtganctactcatcygaganctccctaagggctaacattncatgtttccgtctcactagctacacgttct

SEQ ID NO: 1564 - DNA, 602 bp, Homo sapiens
  misc_feature 597, 598: n = A,T,C or G
ctagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaannattt

SEQ ID NO: 1565 - DNA, 473 bp, Homo sapiens
  misc_feature 214, 291, 295, 345, 375, 442: n = A,T,C or G
ctagtccagtgtggtggaattcatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgttnagagataaggtgatgtcagagtttaataacaacttccggcagcagatggagaattacccgaaaaacaaccacactgnttcnatcctggacaggatgcaggcagattttaagtgctgtggggctgctaactncacagattgggagaaaatcccttccatgtngaagaaccgagtccccgactcctgctgcattaatgttactgtgggctgtgggattaatttcaacganaaggcgatccataaggagggctgtgtggaga

SEQ ID NO: 1566 - DNA, 53 bp, Homo sapiens
  misc_feature 15, 24, 28: n = A,T,C or G
ctagttattaatagnaatcaattncggngtcattagttcatagcccatatatg

SEQ ID NO: 1567 - DNA, 136 bp, Homo sapiens
  misc_feature 91, 104, 117, 126: n = A,T,C or G
ttattgatttttttttttcactttccccatcacactcacacgcacgctcacactttttatttgccataatgaaccgtccagcccctgtggngatctcctatganaacatgcgttttntgataactnacaaccctac

SEQ ID NO: 1568 - DNA, 192 bp, Homo sapiens
  misc_feature 4, 16, 17, 48, 52, 57, 82, 91, 98, 109, 123, 151, 155, 162,166, 168: n = A,T,C or G
ttgngtctgtgtgagnnggttgaccttcctccatcccctggtccttcncttnccttnccgaggcacagagagacagggcagnatccacgtncccattntggaggcaganaaaagagaaagtgntttatatacggtacttatttaatatccntttntaattanaaantnaaacagttaatttaattaaagagt

SEQ ID NO: 1569 - DNA, 575 bp, Homo sapiens
  misc_feature 358, 505, 511, 513, 547: n = A,T,C or G
ctagttctgtccccccaggagacctggttgtgtctgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggngacagtcactagcttatcttgaacagatatttaattttgctaacactcagctctgccctccccgatcccctggctccccagcacacattcctttgaaataaggtttcaatatacatctacatactatatatatatttggcaacttgnatttgngngtatatatatatatatatgtttatgtatatatgngattctgataaaatagacattgctattc

SEQ ID NO: 1570 - DNA, 392 bp, Homo sapiens
  misc_feature 10, 114, 374: n = A,T,C or G
ctagtccagngtggtggaattccgccgccatcatgggtcgcatgcatgctcccgggaagggcctgtcccagtcggctttaccctatcgacgcagcgtccccacttggttgaagntgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgnctgattctaatagagagc

SEQ ID NO: 1571 - DNA, 390 bp, Homo sapiens
gaaggacgtttgtgttggaagccctggtatccccggcactcctggatcccacggcctgccaggcagggacgggagagatggtgtcaaaggagaccctggccctccgggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattca

SEQ ID NO: 1572 - DNA, 383 bp, Homo sapiens
  misc_feature 368: n = A,T,C or G
ctgcagcttctgctgctgaggccgggattgctacgactgggactgaaggtgaaagaggtggaatccgaagtcctgggactgcgggatgctaaacattgaaagctgggtgtaggcactgcagggagagtgtggaggtctgacagggtaggaatatgtgggagggctgggctaggaatggccttggaggctggcctgtgtggatatggcaccaattctaccctgctcctcttttccttttcccagactcagacgatgccctgctgaagatgaccatcagccagcaagagtttggccgcactgggcttcctgacctaagcagtatgactgaggaagagcagattgcttatgccatgcagatgtccctgcangggagcagagtttgg

SEQ ID NO: 1573 - DNA, 149 bp, Homo sapiens
cctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttgg

SEQ ID NO: 1574 - DNA, 143 bp, Homo sapiens
ctgccaggctgaaaagaagcctcagctcccacaccgccctcctcaccgcccttcctcgggagtcacttccactggtggaccacgggcccccagccctgtgtcggccttgtctgtctcagctcaaccacagtctgacaccagag

SEQ ID NO: 1575 - DNA, 112 bp, Homo sapiens
ctgcatccaccctctttcagggggtagagccactatacttctcatgtagatcagccacattgtcactggagactcggatccagccatcctcccgcacgtggtagaggttgac

SEQ ID NO: 1576 - DNA, 198 bp, Homo sapiens
ccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaggcccttctgtctgtcagg

SEQ ID NO: 1577 - DNA, 444 bp, Homo sapiens
cctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgtcatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccagg

SEQ ID NO: 1578 - DNA, 294 bp, Homo sapiens; identical to SEQ ID NO: 1031

SEQ ID NO: 1579 - DNA, 295 bp, Homo sapiens
  misc_feature 176, 181, 182, 248: n = A,T,C or G
ccacaaagccattgtatgtagctttagctcagcgcaaagaagagcgccaggctcacctcactaaccagtatatgcagagaatggcaagtgtacgagctgtgcccaaccctgtaatcaacccctaccagccagcacctccttcaggttacttcatggcagctatcccacagactcanaaccnngctgcatactatcctcctagccaaattgctcaactaagaccaagtccccgctggactgctcagggngccagacctcatccattccaaaaatatgcccggtgctatccgcccag

SEQ ID NO: 1580 - DNA, 166 bp, Homo sapiens
cttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcac

SEQ ID NO: 1581 - DNA, 449 bp, Homo sapiens
  misc_feature 420: n = A,T,C or G
ctgaggcaacagaataaatgcagaggcattacaatgaatcccacttaatataaagaactatacagaccaacacttctctacaaaatttttttttcctcattgccagttaaatacagagttttactttcatagcttaacaatgaagggtcatacactgaagccaatacatatacctagcatttcagtctaagcttgtccacgtacatagctgaagtcaattacaaggtttggcctagaaatgctaggggaacttctttgtagtttttacaggtattaaacttcatcttgcacactgaagtcatcatacatacagggcaaaatcagagcttttatatttgcgtttattcttcatttaactttttataacactactatagtttattaaaacaaaaaacaaagagcaagtagtgagcatattangattacagtcctttcactcattcacacct

SEQ ID NO: 1582 - DNA, 302 bp, Homo sapiens
ccaatgggctttgctgtagcttgctgaaatcaccaagcaggagagatttaaccagaggcgatgtgtccagtcaccagcatagagccatcctctgtgtcaccatccacacgcagggccttctggcagacctcatgcaatgccctccatgttaatattcatcagaaaatggataattaggggggccagcaaaaatatcaagggtcaaatatcgcacatttctgtttaggccatctatggctttcatctcctctgaagtcaactggaattcaaacacctgcacgttctgtctgatgcgctgctca

SEQ ID NO: 1583 - DNA, 170 bp, Homo sapiens
ttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggagg

SEQ ID NO: 1584 - DNA, 368 bp, Homo sapiens
ccagacgtggtggctcacacctgcagtcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccagg

SEQ ID NO: 1585 - DNA, 392 bp, Homo sapiens
caaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttctaagagtactgtgtcttcctgtcctgcatcgccatgatgtgtaacgaattctttgaaggcttcccagataagcagcccaggaagaaatgaaaactcctctgatgtggttggggggtctgccag

SEQ ID NO: 1586 - DNA, 158 bp, Homo sapiens
cctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattgg

SEQ ID NO: 1587 - DNA, 85 bp, Homo sapiens
ccaatgtacatggtggactatgccggcctgaacgtgcagctcccgggacctcttaattactagacctcagtactgaatcaggacc

SEQ ID NO: 1588 - DNA, 369 bp, Homo sapiens
  misc_feature 363: n = A,T,C or G
ccaggctaccttcccactggagacaggcagggggacaggtgctaagggacctggcaggcagggctggcaggccccatggcgcctgttccagcagatgacaagcccaggtcagggtagagcgggcaggaggggggacgagggctcccacaacatgattttgtgtaaaatatggcagcgacacacgctcagggccgggaggtgggggttagggtggggacggcggcaacatcgtgtaaaaaagtgtcccagttcccatagcaaagagagctgtgaccgggtgttcagagcttctccagtacaagggggaaagccgcccggcgggggcggcgggcagggacatcatttggtttcctggtgctgtcngtccga

SEQ ID NO: 1589 - DNA, 361 bp, Homo sapiens
ctgtagcttctgtgggacttccactgctcaggcgtcaggctcagatagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggcgggaacagagtgaccgagggggcagccttgggctgacccaggacggtcagcttggtccctccgccgaacagtacaaagggactcaggctgttatcataggactggcagtaataatcagcctcatcttcagcctggagcccag

SEQ ID NO: 1590 - DNA, 434 bp, Homo sapiens
  misc_feature 397: n = A,T,C or G
ctggagaaggtgtgcaggggaaaccctgctgatgtcaccgaggccaggttgtctttctactcgggacactcttcctttgggatgtactgcatggtgttcttggtgctgtatgtgcaggcacgactctgttggaagtgggcacggctgctgcgacccacagtccagttcttcctggtggcctttgccctctacgtgggctacacccgcgtgtctgattacaaacaccactggagcgatgtccttgttggcctcctgcagggggcactggtggctgccctcactgtctgctacatctcagacttcttcaaagcccgacccccacagcactgtctgaaggaggaggagctggaacggaagcccagcctgtcactgacgttgaccctgggcgaggctgacnacaaccactatggatacccgcactcctcctcctgagg

SEQ ID NO: 1591 - DNA, 439 bp, Homo sapiens
  misc_feature 409: n = A,T,C or G
gctttcgccagaaaatgttgcatgtcaaacaatatgtgatccatactgtgtgtcgtccttgggggtttatttgactttgtcacaatgacagccaacagtgagactgataagcctgtaaaaataaaaaaataagactaatcaaatagacatggcattttaatctcaaagtgcaaaatcatctaactgaaaatgacggcattgagaaattccagtggttaaaaatgaatcaaaacttcattacgcaggcagtggaagtgtgttgaaagatttaccaggggtgtcaagttttagacactcagaaaggcaccattctagccatcttgattggataacatgtatatacttatgtccctacgatattcaaaagataatactgttttagtacaaaacaatcaaacaaggcaaagantcaaaaccaagccaacccaaatatccccag

SEQ ID NO: 1592 - DNA, 74 bp, Homo sapiens
  misc_feature 53: n = A,T,C or G
tttttttttctaatgttcacagtccctgctttatttccatttgttcacacacnctttaaaaaaaaaaaaaaaaa

SEQ ID NO: 1593 - DNA, 288 bp, Homo sapiens
ccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattgg

SEQ ID NO: 1594 - DNA, 455 bp, Homo sapiens
ccacacagactcaccaagccacagacttgtcttccacaagcacgttcttaccttagccacgaagtgaccaagccacacgtactaaaggttgaactcaaagatatgtacagggtattaaacaaataccaaggggaacagttaacttcaatacaaggtcaaaatcagcaacaagttctacaatccagtgctgatatcagatacaagcttcaaggacaatttcttttcgaaggcttattccagtttcgtgaggctagcatgaggtgtgtgcatttgccaggggcaaatttctattctcaattaacccatgcagcaaatgctacgcatctgctgagtccgtttagaagcatttgcggtggacgatggaggggcccgactcgtcgtactcctgcttgctaatccacatctgctggaaggtggacagtgaggccaggatggagccaccgatccacaccgag

SEQ ID NO: 1595 - DNA, 367 bp, Homo sapiens
  misc_feature 360: n = A,T,C or G
ccaggctaccttcccactggagacaggcagggggacaggtgctaagggacctggcaggcagggctggcaggccccatggcgcctgttccagcagatgacaagcccaggtcagggtagagcgggcaggaggggggacgagggctcccacaacatgattttgtgtaaaatatggcagcgacacacgctcagggccgggaggtgggggttagggtggggacggcggcaacatcgtgtaaaaaagtgtcccagttcccatagcaaagagagctgtgaccgggtgttcgagcttctccagtacaagggggaaagccgcccggcgggggcggcgggcagggacatcatttggtttcctggtgctgncagtccg

SEQ ID NO: 1596 - DNA, 193 bp, Homo sapiens
ctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggccccgggaggcccctcgagg

SEQ ID NO: 1597 - DNA, 145 bp, Homo sapiens
ccatgctggatgttctgctgcttagacctgatctgctgccaattaccaggggcaggtcaaggatgaccttcttggatccaggaacgctaacatagatcagtaaggaatattcaactcgaaggatgttgcagcccaggatagaagg

SEQ ID NO: 1598 - DNA, 445 bp, Homo sapiens
ctgcctataaaactagacttctgacgctgggctccagcttcattctcacaggtcatcatcctcatccgggagagcagttgtctgagcaacctctaagtcgtgctcatactgtgctgccaaagctgggtccatgacaacttctggtggggcgagagcaggcatggcaacaaatcccaagttagggtctccaatgagcttcctagcaagccagaggaagggcttttcaaagttgtagttacttttggcagaaatgtcgtagtactgaagattcttctttcggtggaagacaatggatttcgccttcactttcctgtccttaatatccactttgttgccacacaacacaatggggatgttttcacacactcgtaccagatctctatgccagttaggcacattcttgtaagtaactctcgatgttacatcaaacattatgatggcacac

SEQ ID NO: 1599 - DNA, 142 bp, Homo sapiens
cctgccccagggggaagcacggacccgagacgacggcgatgaggaagggctcctgacacacagcgaggaagagctggaacacagccaggacacagacgcggatgatggggccttgcagtaagcagcctgacaggagcaatgg

SEQ ID NO: 1600 - DNA, 297 bp, Homo sapiens; identical to SEQ ID NO: 389

SEQ ID NO: 1601 - DNA, 289 bp, Homo sapiens
ctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgcctcggcaaaaaagcacaagcgaaccccagccctgattgccctgcgctaccagctacagcgtggggttgtggtcctgg

SEQ ID NO: 1602 - DNA, 398 bp, Homo sapiens
  misc_feature 274, 312, 329, 332, 368: n = A,T,C or G
gggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgagaaggaaggactcaagtacaagtccaaagtttcactgaaaggcaatagagaaagtgatggatttagagaagaaaaaaattatnaacttaaagagactggatatgtagtggaaaggcctagnactacaaaagataagcncanagaagaagacaaaaattctgaaagaataacagtaangaaagaaactcagtcacctgagcaggtaaa

SEQ ID NO: 1603 - DNA, 438 bp, Homo sapiens
ctggtgatctgctttcttaccctaactcttgacaaatgagtcgtctactattttaaagagtctggaggtctctgactctgccataacaataacctgctgttaatttataacacagatttttgtttggaagagccttatttgaaatacactttgattcattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaa

SEQ ID NO: 1604 - DNA, 297 bp, Homo sapiens; identical to SEQ ID NO: 389

SEQ ID NO: 1605 - DNA, 451 bp, Homo sapiens
ggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaag

SEQ ID NO: 1606 - DNA, 272 bp, Homo sapiens; identical to SEQ ID NO: 1006

SEQ ID NO: 1607 - DNA, 444 bp, Homo sapiens
ccaggctggtctcaaactcctcacctcaactgatccgcccaccttggcctcccaaagtgctgggattataggtgtgagccaccgtgcccaaagttaagtatttttgatcaagtgttttgtcttttgtgcaaggcatttgtggctctgtcatagcagaggaaaacaaaacatgcctatcaaatgaatcaagtccgacctcttctcatattgagcaactagaggtctaggaacatttcccctacctgtcattctcatctggcataccaggtgtacatactccttcttattctcctctgttaccaagatgttggccccattgggtttgaggtcacgaacttcacaaactccaaactcttggacctcagtgctgaaggtgaggtcatagcctagtgtggagacatcattttccagcagataaaccagaccttggtagaagtggtaatc

SEQ ID NO: 1608 - DNA, 189 bp, Homo sapiens
caaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcgcacccctgtcccacccacacag

SEQ ID NO: 1609 - DNA, 426 bp, Homo sapiens
cttttgttatccttagaggactcactggtttcttttcataagcaaaaagtacctcttcttaaagtgcactttgcagacgtttcactccttttccaataagcttgagttaggagcttttaccttgtagcagagcagtattaacacctagttggttcacctggaaaacagagaggctgaccgtggggctcaccatgcggatgcgggtcacacggaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggcca

SEQ ID NO: 1610 - DNA, 447 bp, Homo sapiens
cagggctatagtgcgctatgttgatctggtgttcatgctaagttccgcatcaatatggtgacttcttgggagtgggggaccaccaggttgcctaaggaggggtgaacctgcctacgttggaaatagagctggtcaaaactcctgtgctcatcagtagtagaattgcacctgtgaatagccaccgccctccagcatgggcaacatagcaagaccctgcctcttaagataaaaattggaaaacactggtaggaaaaaaaggctgtttggtctaaataagtctggattgggtataaatgacacaaaactatcatgaatttgaaagcatttctaatttcttgaaagtctgaaaaagtttaaacagaattttagctgaaaagtcctgaaagacatttgaaaaaaaacagcaagaacacttaaaactattcaaggtttgggctgggcacagtg

SEQ ID NO: 1611 - DNA, 238 bp, Homo sapiens
ccaccggggttgacctctctcgctagcagggcccacccagctcactccccgcgtcttccatcccctctaggattcccattgtcccctactccagcactaggcaggcacccccagcccactgcgactcccaccacgaaggaccccagccctctctcagccaacacggccccgcccaccgtctcagacatcgtgcttcttctggtgggccaggagtctctcctcgtcgtcgaaggtctgg

SEQ ID NO: 1612 - DNA, 293 bp, Homo sapiens
ctgctgcttgtatcctcgggagagggtttcccactctgagcgggtgggaaggcaatgccaaacatccgggaaaaataaaaccactgtctccacatgagctggaactgtacgccccttgtgggtctcctcagggcgatggtagcgaatctctgcaaaacggtaccattgtgtgcacacacttagatcaatgcctgtcagagccttacaacaacgaatagcagtcttaatcaacacagagggatctttttctgggtctggtccatccaacgaaggagaccagtggcccccaatgg

SEQ ID NO: 1613 - DNA, 224 bp, Homo sapiens
ctggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgactctgccgatgtgg

SEQ ID NO: 1614 - DNA, 439 bp, Homo sapiens
ctccaccctggcgatggctccctggtcctactttctctctcaaactggctttttctcattcctttgactccgccagacttcctcgcccccatgacctggtgttgtgtctgatcaccccaacattcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaagaatcatctcttttgaaaaatcgattcatcaaatgaatcttcggccaacaactgttcaagaaggattcaaatatcacaggttccaagaagtaaagctttggaggtcacaaaattagcaatagaagctgggttccgccatatagattctgctcatttatacaaataatgaggagca

SEQ ID NO: 1615 - DNA, 237 bp, Homo sapiens
aggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtagg

SEQ ID NO: 1616 - DNA, 266 bp, Homo sapiens
ctgggctctagtttcattccatctgtcattctcaggtaacagggacacatgtccaagtgttggcccccgtggcatgattgtagctttgttgataggcattgcatcttttgtgtaatatgcaataatggcatgaccagattcatgatatgctgtgatggttttgtttttgttatcaatttccacacttcttctttcaggccccattagaattttgtctttggaaaactccagctccttcatggtaaccatttcttttccatcaacag

SEQ ID NO: 1617 - DNA, 185 bp, Homo sapiens
  misc_feature 62: n = A,T,C or G
ccatggctaggtttatagatagttgggtggttggtgtaaatgagtgaggcaggagtccgagnaggttagttgtggcaataaaaatgattaaggatactagtataagagatcaggttcgtcctttagtgttgtgtatggttatcatttgttttgaggttagtttgattagtcattgttgggtggtg

SEQ ID NO: 1618 - DNA, 354 bp, Homo sapiens
  misc_feature 201, 214, 225, 230, 232, 241, 245, 249, 278: n = A,T,C or G
ctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatggngatagtacacatntcactcagagngcatntntgcatcttntaanatanatttcttaaaagcctctaaagtgatcagntgccttgatgccaactaaggaaatttgtttagcattgaatctctgaaggctctatgaaaggaatagcatgatgtgc

SEQ ID NO: 1619 - DNA, 170 bp, Homo sapiens
  misc_feature 145, 146: n = A,T,C or G
ctgtgctgtggagagaagctgatgttttggtgtattgtcagccatcgtcctgggactcggagactatggcctcgcctccccaccctcctcttggaattacaagccctggggtttgaagctgactttatagctgcaagtgtatctnncttttatctggtgcctcctcaaac

SEQ ID NO: 1620 - DNA, 386 bp, Homo sapiens
cctgttgattgcatactgtagaagatttgatgttcagactggttcttcttacatatactatgtttcgtctacagttggtaaatttttgtttttctttgtattaaatgttgaattgtattgtctggaggaaaagacagaggtctaaaaataaagaaggagtacagtttgggcatggtggttcacccctggagtcctagcactttgggggccaaggcaggcagattgcttgagcccaggagttctagatgagcctgggcaacatagtgagaccccatctctaaaaaaacagttttagggccaggcacagtggctcacacctgtaagcccagcactttgggaggccgaggcaggcagatcataagggcaagagattgagaccatcctgg

SEQ ID NO: 1621 - DNA, 346 bp, Homo sapiens
  misc_feature 267: n = A,T,C or G
ccaattctgcccgttccccgtgggccaacaacactggggttgtatgcgtctggaaccctgtgatagtcttcggcttgccagcctggcccaccacatccactgcctggcccacacggacagacactggcaatggccgcagctcctcatcaaacgtaaccagcattcggggctgcatggcagccaccagcccatacaatacatagtgtgatttgcctagaataatgtttcgaacatccaggaaagagacaagcacagtgagcagtccanccacggccacctggctcataagctgccggtcgctgtggtaggggcagagggtaagggtgcccttccctaaatgtgtcag

SEQ ID NO: 1622 - DNA, 366 bp, Homo sapiens
ggaagtttgtgctctctgcgtggctaagtttttcacctactaggacgggggtggggtggggagaacaggtgtccttctaaaatacagcacaagctacagcctgcgtccagccataacccaggagtaacatcagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggggtacacatctttctggaatgactgcatatcatcagg

SEQ ID NO: 1623 - DNA, 165 bp, Homo sapiens
ctgttgattggctgtgacactgctttgtgtcatcttcttaccatgatcaaaggcgaaggaagggatctcttttgggacattgtgattgttttagcagagagagaaagagatgaaatacacttcggttttctcttaaaagatgcatgtatcatacagtgctttaag

SEQ ID NO: 1624 - DNA, 227 bp, Homo sapiens
ccaatgcccggagcaggccctctttccatcccctgtcggatgagctggtcaactatgtcaacaaacggaataccacgtggcaagccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatgg

SEQ ID NO: 1625 - DNA, 373 bp, Homo sapiens
ctgtagcttttgtgggacttccactgctcaggcgtcaggctcaggtagctgctggccgcgtacttgttgttgctttgtttggagggtgtggtggtctccactcccgccttgacggggctgctatctgccttccaggccactgtcacggctcccgggtagaagtcacttatgagacacaccagtgtggccttgttggcttgaagctcctcagaggagggtgggaacagagtgaccgagggggcagccttgggctgacctaggacggtcagtttggtccctccgccgaacacccgaagataattagtgctgtctgttgagtaacaatagtagtcaccttcatcttccacctgggccccagtgatggtcaaggtgg

SEQ ID NO: 1626 - DNA, 367 bp, Homo sapiens
ccagacgtggtggctcacacctgcaatcccagcaccttaggaggccgaggcaggaggatccttgaggtcaggagttcgagaccagcctcgccaacatggtgaaaccccatttctactaaaaatacaaaaattagccaagtgtggtggcatatgcctgtaatcccaactactcagaaggccgaggcaggagaattacttgaacgcaggagaatcactgcagccctggaggcagaggttgcagtgagccgagattgcaccactgtactccagcctgggtgacagagcaagactccatctcagtaaataaataaataaataaaaagcgctgcagtagctgtggcctcaccctgaagtcagcgggcccagg

SEQ ID NO: 1627 - DNA, 424 bp, Homo sapiens
ctggataaggacatcaataccttctctatgcgtgtcagggtgtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctgg

SEQ ID NO: 1628 - DNA, 314 bp, Homo sapiens
tcgactgttatagcttagaaagcaacactactactatgagactataaaacattaaactattttaagaaaaccacgctgtggaaaaatggagccatttttgtcaaaaagtggctcaaagcacaaaactgctcagatgttcaagagtcctaggagtctgggctgcacagtattaaggggtgagaggagaccgacagcctgtttgaatcaggcttgtgagcccagctcatctgacaacttcaaagagcttctctgcctatacattccaccgtttagcataagacaccactttacgctatttacaagtctccttttgg

SEQ ID NO: 1629 - DNA, 393 bp, Homo sapiens
  misc_feature 284: n = A,T,C or G
ctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgttttcccccaatgtttaaaatgtttggatggtntgttgttctgcctggagacaaaggtgctaacatagatttaagttgaataacattaacggtgctaaaaaatgaaaaattctaacccaagacatgacattcttagctgtaa

SEQ ID NO: 1630 - DNA, 317 bp, Homo sapiens
ctgcaagaatatcagaaatcaatacaaacaagtattgacaggtgttacagacatgcaaaatatccttcaatgcaacgaatttttaagaaatcagctagcctatattaatcagatgttttaggtcaaaccaagtttccatctcgggctcagtgaaatagtattaactcattgagtctcctttcccccaggaatgttgggaatggcagaacagaaagagctatcactccttaaattcttttatgcgagtgttactccaacacttattttacttggtttacttggaatgtatgagaggaaactgatgttttttacaatgg

SEQ ID NO: 1631 - DNA, 262 bp, Homo sapiens
ccttaggcaagtcaccttacttatctaagactgtttccccacctggaagatgccctacaagcctcctgtggctgtgtttagaaagcatgcccggcctttcttgacagccagccaccccagatgatggcagggcaaggaagactgttaggagtcagagtgctcccctcaggtggaaggaaactgggccaactctactttgtaagccatagggtgccaggtagcccggccaccctgagcctgtgcctccactgcccccgcgtgg

SEQ ID NO: 1632 - DNA, 138 bp, Homo sapiens
ctggaattaattcttcgacaactccagaccgaccttcggaaggaaaaacaagacaaggccgttctccaagcagaagtgcagcacctgagacaggacaacatgagactgcaggaggagtcccagaccgcgacagctcag

SEQ ID NO: 1633 - DNA, 192 bp, Homo sapiens
  misc_feature 17, 55, 80, 81, 94, 95, 106, 107: n = A,T,C or G
ccttgaagggacctcanagcaaaggaagagacctgggtgtggtgaggcatcccanggcatggaagggaccggttgtgctnngggaatccactgnnccctccttggnnaaaaaagcacaacacatcatacatatttaccagaccagaagcgctggccccaagtctccccaacctggtcgggggaacctcctgg

SEQ ID NO: 1634 - DNA, 447 bp, Homo sapiens
ctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatg

SEQ ID NO: 1635 - DNA, 364 bp, Homo sapiens
gttttatttgagacataaaaacacatgtgtttctattacatagtgtggggtttagggtcctggtttctaagacaagactttatttcaccctgtatcacagcttcctgggaaatgaattagggagcaagagacggcctggcaagaaaatcattattgttgctgggaagttgcaaagaaaggggagagtttattcaaattagtgtaacagagcccccaggatgaagagagtggtgcagggaaaaggtctaaattcctggtgttggtggggacactggcacatcccacagcaaggactcagccctcaacggcggcggctgggtcttgggaggggagtggtgggagggtaagggctcctcagctccct

SEQ ID NO: 1636 - DNA, 399 bp, Homo sapiens
ctggctggctagactgtttgtgcgccaagaggatggtcagcgctgctttccagcctggctctgctggggcgctggcatctggttcagttccaccattctccctgctttctttgccaagtgtgatattcacccaagggcaccagtctctatgctgagaggtgggatcaaagaagcttcgggaagatgtgtccgaactgctggaggagcagaggcgagctcgcttggctttccgcagagggctagatggtacctccaggccaggggtgtctcctgttcccatgcttcgggtcactgggcgagttctggtggtggggctagcagcctctggctcaggacggtcaacaggactggaagagtcccagctccgagttcgagagacaatgggaccagggctctttt

SEQ ID NO: 1637 - DNA, 246 bp, Homo sapiens
ctgagctttcagcagataaatcacagcagaaatagaatcaccctaggactttcaatcaaaagctggaagtccaccttacagaaagacaaaaagaaacccctttttatatcttaacaaagcaatagctctcaagcagcagagcatctcgaggaagaaagcttgcccggtcgccatcccatcatgccagagcgtgcagtgtccacccttgactacgctggggaattgctgattttttgaaaaagcttg

SEQ ID NO: 1638 - DNA, 453 bp, Homo sapiens
ccaagagttctccactgtgaagactgaaaggacctggtgacatttcggcatcagtcctgttaccacttggaggtaacagaagcaggctcgtgtcctcctttaattctaccacactacatgactcgcaattggttctgaaattagaacgttcaccatcgtacttaaaatcttaggggcatgaagagtcagctagaacaaggaaaaagaaagtcgcaggtagtaggtaagtaggtgggcacatgaaaagccaagctgctctgtccaacaccagtgtacatgtgctttaactaaatgaactccagaggccaacagcagcagacctgctcaattcaccttccaaatcagaacaagaccaaaaagctcaggcttgagttgtcaactatgcataggttccgccagtgatgaggagctcgtaagcaggatctctactccttctgcacaacacgatgcaag

SEQ ID NO: 1639 - DNA, 197 bp, Homo sapiens
tttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattgg

SEQ ID NO: 1640 - DNA, 278 bp, Homo sapiens
ccagagcggtgagtcccaccacctcgaactctgggaattcgagccacagctctgccagtaccccaagactcagcactagtctgatgacctgctaattcactgacagcatagggctgtctgttgtttttgcgcaagttggtgtgaacaaagttcacaatatctggtcgaataggagccttgaatacagcaggcaaagtgacatttttgccagatgactcccccttttcggagtacaccgatatcagtgggcgagcgcacgccatggcggacctcggccg

SEQ ID NO: 1641 - DNA, 227 bp, Homo sapiens
ccattgttcccgtgcatcgaagcttgcaggcagcttcaggtcctcggtaaacataactctctggggtggcttgggcccacccaggaaggtaccacatagcctcttcaagtagctcatgtccacgttgtagaagttgtgcccggcttgccacgtggtattccgtttgttgacatagttgaccagctcatccgacaggggatggaaagagggcctgctccgggcattgg

SEQ ID NO: 1642 - DNA, 299 bp, Homo sapiens
ctgcacatcaaggacatcttcaggaagttcaggattgccgtagctaaactgaaaaccaccatccatggactctccaaaccaaacgtgtttcttctcagcactagaatctgtccaccagtgtttccgtggaacattcaaaggattggcacttatgcatgtttccccagtttccatattacagaataccttgatagcatccaatttgcatccttggttagggtcaacccagtattctccactcttgagttcaggatggcagaatttcaggtctctgcagtttctagcggggtttttacgag

SEQ ID NO: 1643 - DNA, 301 bp, Homo sapiens
ccaagggctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacag

SEQ ID NO: 1644 - DNA, 365 bp, Homo sapiens
ctggtgagcgaaggatgggagcagagaacagagctaaaacccctggttttcctttccccagatgtaaagcctgctagctggaactcacagaagattggaacaaaaagataggagatggacacctgggggactgctccagcacgaagggaagcgatgagcatcacacagcagggccattgcaggggacaggtgctgtaattcctgcccagagaacttgaaagcttacagtgtgctcacaggaaggaatcggctcagctagtccagaaattgctgcatttcccatattacttagttctttattcatcctgtggtaaagagtcacccttgttttccgtatctataaaactgaaagacttaaaatttac

SEQ ID NO: 1645 - DNA, 249 bp, Homo sapiens
ctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacag

SEQ ID NO: 1646 - DNA, 433 bp, Homo sapiens
  misc_feature 398: n = A,T,C or G
ctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaggtgctggggaggcccgggacccctgtatagtatggcaggctggtgtaaactgtagccaggaggcagcgccgggttcaggaatgtctgctgcgtggnatggtgagtctgcgtctggtttctgttggggttgg

SEQ ID NO: 1647 - DNA, 451 bp, Homo sapiens
ccagcttgcaagcacgctggcaaatctctgtcaggtcagctccagagaagccattagtcattttagccaggaactccaagtccacatccttggcaactggggacttgcgcaggttagccttgaggatggcaacacgggacttctcatcaggaagtgggatgtagatgagctgatcaagacggccaggtctgaggatggcaggatcaatgatgtcaggccggttggtagcgccaatgatgaacacatttttttttgtggacatgccatccatttctgtcaggatctggttgatgactcggtcagcagccccaccaccatctccaatgttacctccacgagccttggcaatcgaatccagctcatcaaagaatagcacacagggggcagcttggcgggccttgtcaaagatttctctgacattggcctcagactccccaaaccacatggtgag

SEQ ID NO: 1648 - DNA, 176 bp, Homo sapiens
cctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagagg

SEQ ID NO: 1649 - DNA, 435 bp, Homo sapiens
tgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagaccccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattgg

SEQ ID NO: 1650 - DNA, 246 bp, Homo sapiens
ccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccag

SEQ ID NO: 1651 - DNA, 400 bp, Homo sapiens
  misc_feature 171, 172, 303, 344, 354, 357, 366, 367, 379, 391: n = A,T,C or G
cggcaagttctcccaggagaaagccatgttcagttcgagcgccaagaccgtgaagcccaatggcgagaagccggacgagttcgagtccggcatctcccaggctcttctggagctggagatgaactcggacctcaaggctcagctcagggagctgaatattacggcagctanngaaattgaagttggtggtggtcggaaagctatcataatctttgttcccgttcctcaactgaaatctttccagaaaatccaagtccggctagtacgcgaattggagaaaaagttcagtgggaagcatgtcgnctttatcggctcagaggaggaattctgcctaagccaactcnaaaaagccgnacnaaaaattanngcaaaaagcgtnccaggagccgtnctctgacag

SEQ ID NO: 1652 - DNA, 338 bp, Homo sapiens
ctgggggtgcccatcttctgtgctctgtggtacatatctgtgtcgccaaagtagcgtgcccggtacagcaagccttccttctgctgcttctccttccagcagttgttccggaggttggcgatataatcatcttccacattccgctcgactgttttgaggctggagcctgtgtactcttcggagaaagtgtctcccacatagtagacgacacccaggtggtcagtgactcgcctgtggatgtggcccacagacggtcttggactcagactgtagggtggactggagaccatgagctggctgagagctgacacgagaatcaggatgaggataggcatcag

SEQ ID NO: 1653 - DNA, 167 bp, Homo sapiens
gcggtggagccgccaccaaaatgcagattttcgtggaaacccttacggggaagaccatcaccctcgaggttgaaccctcggatacgatagaaaatgtaaaggccaagatccaggataaggaaggaattcctcctgatcggcagagactgatctttgctggcaagcag

SEQ ID NO: 1654 - DNA, 1034 bp, Homo sapiens
  misc_feature 88, 827, 882, 897, 905, 933, 945, 950, 955, 973, 976, 991,999, 1010, 1022, 1023, 1024, 1033: n = A,T,C or G
atgcatgctcgagcggccgccagtgtgatggatatctgcagaattcgcccttagcgtggtcgcggccgaggtccaagagggagataanacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggctttgtgcatagtgtcttcatgtcgcgtatagttgagcgcgttcttagcagttggcttcatggacagctcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgcgcaaagcttaacaatttgtaggaaactttgggtctttttgtcccaagaaaaaggaatgtcttgacaggcttaaagcttttcgtccccttgcaccttaaaactcgaaagttaggnaaaatccctttaaagggctttttttaatagccagaacttcccaaaaggaatggcnttttagggaatttcntagccatngctttttaaatttaaagaaatttttaanaaccttgccccnggggnggggncccgctccaaaaaggggnggnaaaattccccagccnaccctttnggggggggccncgttttcctttnnnggggggaanc

SEQ ID NO: 1655 - DNA, 487 bp, Homo sapiens
atgcatgctcgagcggccgccagtgtgatggatatctgcagaattcgccctttcgagcggccgcccgggcaggtcctactcttctccgtccattgtactatctgcccgtggtggggatggcagtaggatcatatttgatgacttccgagaagcatattattggctccgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggacctcggccgcgaccacgctaagggcgaattccagcacactggcggccgttactagtggatccgagctcggtaccaagcttggcgtaatcatggtcatagctgttt

SEQ ID NO: 1656 - DNA, 514 bp, Homo sapiens
  misc_feature 55: n = A,T,C or G
atgcatgctcgagcggcccgccagtgtgatggatatctgcagaattcgcccttancgtggtcgcggccgaggtcctacccataatccagagaggcttgcccagaggaggactacgtgggggacgtgccaccagaaccctacttgggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagacctgcccgggcggccgctcgaagggcgaattccagcacactggcggccgttactagtggatccgagctcggtaccaagcttggcgtaatcatggtcatagctgttt

SEQ ID NO: 1657 - DNA, 605 bp, Homo sapiens
  misc_feature 78, 91: n = A,T,C or G
atgcatgctcgagcggccgccagtgtgatggatatctgcagaattcgccctttcgagcggccgcccgggcaggtccanacgctgacattgnttctgagtccttaagcaggaaggatttgaaatcctggagcttggcagtcttgctcttcacctctaagccaatgttgaccccttcatctataaagtccacaactctccggaagtcatcctcacggaactgtcgagaagttaaggctggggccccaagccgcaggccgcccggtgtgatggcacttcggtctccaggacaggtgttcttgttggcagtgatggatacaagctctagcacccgctcagcccgagctccatccaggcccttgggccgcaggtccaccagcaccaggtggttgtcagtaccacctgataccagtgagtagcctcgccctagcagggcatctgccatggcccgagcattcttcagaacctgcagggagtactcccggaacatgggggtgcaggacctcggccgcgaccacgctaagggcgaattccagcacactggcggccgttactagtggatccgagctcggtaccaagcttggcgtaatcatggtcatagctgtttc

SEQ ID NO: 1658 - DNA, 784 bp, Homo sapiens
  misc_feature 3, 4, 10, 19, 22, 53, 76, 85, 87, 149, 184, 713, 747: n = A,T,C or G
agnnttccgncggccctcnagntgcatgctcgagcggccgcgcagtgagatgnatatctgcagaattcgcccttancgtgggcgnangcatgacgctcgggatcagaactaaaacaagtgagatcacccctctaattatttctgaactnggttaataaaagcttataagatttttatgaagcanccactgtatgatattttaagcaaatatgttatttaaaatattgatccttcccttggaccaccttcatgttagttgggtattataaataagagatacaaccatgaatatattatgtttatacaaaatcaatctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttagaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaaccgacatttatcttcaaaacaccaaattgtctttagaaaaaattaatngtgattaccaggtagaaggacctgcccgggcggnccgctcgaaagggccgaaattccagccccacctgggc

SEQ ID NO: 1659 - DNA, 789 bp, Homo sapiens
  misc_feature 2, 4, 19: n = A,T,C or G
tngngccctctagatgcangctcgagcggccgccagtgtgatggatatctgcagaattcgcccttagcgtggtcgcggccgaggtccattaaagataagtttggctaactattttactgaagagactaatggtcttccctctgttgtactgctatgtttcttgatctgtttttccccaatgtaacagtctacattgaagtcctttagctctctccatatactaattgacatttgttaaggattcaatattttgtgaattctttttacccttaaaatgcatatctttcagagagataagaatgaattttgcaataatttatatgcagagtgtgcttatgggtttctgggagttcaagttagtaccccagagtgcttaaaagtacgatgctaaattctaaggctaatgtaatgactgtagattatctatgtccacattgttcaacagaaatataatgtgaaccacaacataatttttaattttctagtagccatattaaaaaagaaacaagcaaaattaattttaataacagtttatgtaacccagtatattaaaaatatcatttcaacatgtaatcaatataaaagattattaatgaaacaccttatcctctttttcttccatgctaagtcttagatttgagtgtattttgcactcacagcacatctcaattctgactggacctgcccgggcggccgctcgaaagggcgaattccagcacactgggcggccgttactagtggatccgagctccggtaccaagcttggcgtaatcatggtcatagctgttt

SEQ ID NO: 1660 - DNA, 559 bp, Homo sapiens
  misc_feature 3, 53, 313, 323, 330, 368, 411, 452, 457, 460, 463, 470,487, 499, 516, 518, 545: n = A,T,C or G
ccncgccctctagatgcatgctcgagcggccgccagtgtgatggatatctgcngaattcgccctttccagcggccgcccgggcaggtccatcagacttcttgggtgcctggctatattcaatgtgaagtaaaaaatatcccaagtcttacaccaaaatagaggctctgacttagaagtatgcttttagctttctttttaaataagacattctggaagaaaaaaaaagaaaaaggaaagaaaatcaagtttgaaacacagttaacacttattttggcaagaaagcaaccaaaatctaaaaagcataaactatgngtccaaatgnaaaaggnattacagaacaaactgcaagaggggaaaattaaagccncactgaacgaaaaaatacagtatgtctaacattttggaattgnaatttaaaccctaagggcaaaagctgaaaaatcatgcttanacctnggncgngaccacnctaagggcgaattccancacactggcggncgttactagtggatccnanctcggtaccaagcttggcgtaatcctnggcatagctgtttc

SEQ ID NO: 1661 - DNA, 453 bp, Homo sapiens
ttgggccctctagatgcatgctcgagcggccgccagtgtgatggatatctgcagaattcgccctttcgagcggccgcccgggcaggtctgcagtgtccctttttatatcatgctagtgttgagacatacttgactaacttgggaacagttcgatatattgacaaccgtcaacttaagaaaatcaacagcttttggccccagcgtccaagtgaacttttcatggagtgcagaatctcaaatggacaaaatactttgtctttttaaatactgaaaatttaattattagtactatgactgaaagattcttcatggctaaaaagctctgcatcaaactcaattcaggaggacctcggccgcgaccacgctaagggcgaattccagcacactggcggccgttactagtggatccgagctcggtaccaagcttggcgtaatcatggtcatagctgtttc

SEQ ID NO: 1662 - DNA, 809 bp, Homo sapiens
  misc_feature 16, 25, 47, 98, 301, 437, 446, 461, 464, 491, 500, 524, 526,530, 564, 589, 599, 603, 617, 633, 657, 658, 676, 682, 689,696, 709, 726, 738, 742, 751, 753, 755, 762, 773, 776, 779,784, 789, 792, 802, 805: n = A,T,C or G
ctcgagcggccgccantgtgatggntatctgcagaattcgcccttancggccgcccgggcaggtccttagccaaagaatgcagtggagccttcccccnggggctgcattgtgaatgaataccaattgacagcataaaaattaatagtcccatatcagatctggaaggggtttctggggctgtctgatgtccctatcctgttgtagtgaacacaatagcagaaaattctttctgggtccatctgctataaagtcttggtaaaacagcattactatgaagaggatgaactcacctaccttcanatggaggaaaagtgaaaaggacttaggctttagtcctccatgacttttcttaagcactacctacctgtaataagctgagtgcaaaaggatgccgaagaaaatctgcacccagaagctgttagaaagcactgcagangaacagggnatgaataaaataaanagntcttaataaacccttaagattctttgntcaaggggnactttgccaaaaggggcagaatangngggnaaagagttgcttttaatctagctctacactggcntttgaaaataaaatttgcccatttngaaatatatngggntataattaaaatgnggctttttacactggnggggctatataaaaactgggtagnnaaatttccaccgagcatntatggngatttgntcacagnaaacctccgggcnggacccacgctaagggnggaattccagcnacantgggggggncngntacctanagtggatcccnagnctnggggnccccnaanctttgggggngtnaatc

SEQ ID NO: 1663 - DNA, 585 bp, Homo sapiens
ttgggccctctagatgcatgctcgagcggccgccagtgtgatggatatctgcagaattcgcccttgccgcccgggcaggtgatggatgaggagcaaaaactttatacggatgatgaagatgatatctacaaggctaataacattgcctatgaagatgtggtcgggggagaagactggaacccagtagaggagaaaatagagagtcaaacccaggaagaggtgagagacagcaaagagaatatagaaaaaaatgaacaaatcaacgatgagatgaaacgctcagggcagcttggcatccaggaagaagatcttcggaaagagagtaaagaccaactctcagatgatgtctccaaagtaattgcctatttgaaaaggttagtaaatgctgcaggaagtgggaggttacagaatgggcaaaatggggaaagggccaccaggctttttgagaaacctcttgattctcagtctatttatcagacctcggccgcgaccacgctaagggcgaattccagcacactggcggccgttactagtggatccgagctcggtaccaagcttggcgtaatcatggtcatagctgtttcc

SEQ ID NO: 1664 - DNA, 999 bp, Homo sapiens
  misc_feature 2, 5, 10, 22, 83, 150, 176, 189, 264, 275, 283, 286, 302,311, 318, 338, 374, 524, 528, 531, 536, 541, 606, 611, 614,616, 621, 634, 635, 636, 644, 659, 682, 688, 702, 715, 723,726, 768, 777, 779, 789, 796, 802, 810, 819, 831, 836: n = A,T,C or G
  misc_feature 853, 854, 869, 874, 893, 900, 903, 911, 989, 999: n = A,T,C or G
anccngctcnagcggccgccantgtgatggatatctgcagaattcgccctttcgagcgggccgcccgggcaggtctgacaatngattaaacaggcgacatgcaacccccactaaggttaaaagtccaaaactactcacacgcatctcttnattggggaaaagctgagactattatncattcttggtagncttgcaaccttgcatgaagagcacccattgcatttctttcatctttcagaaagcaccggtatctgttccaagggnctaacagtacnaaaatacnttntgggattacacctttnaaacccaanactgttntcattaaaaataattttggnttgtaacaaaattatgaaatacaatgcaagcacctnggtatagcattattactgaaaccacttaattcccagctttttgagttttttaaaaaaacccactgcactaagattcacaattcattgctacatacaaattaaagctagtaagaacacactaacgtcacaagtttctcattctaaagtgcnaaanccntaatngtctngaaagtggaacaggggtaaagggcaaaaattaaccccccccaccccaattaaagtttcctggaangtcantantnttttnaatccccaaaggnnncatttctntttaaaaaaattggntacctttggaactggggtaaagnaaaatnaggaacccctgggnggttttttttatnttttcttnaanccaaccccccaattccaccttaaaaacccccacccggggganggccaaaangnccacccttgnggaaacncttttngtgggggncccggtcgnaaaacccaaccnccctntaaaaagggggggtcgnnaaaaaatttctcccnaaganaaacccacctttggggcgnggggacncgntttacccnttaaaatggggggaattccccgaaagcgtttgggggtaaccccaaaagacctttggggggggaaaaatgaatgggggnccattaaccn

SEQ ID NO: 1665 - DNA, 27 bp, Artificial Sequence
  PCR primer
gctaaaggtgaccccaagaaaccaaag

SEQ ID NO: 1666 - DNA, 37 bp, Artificial Sequence
  PCR primer
ctattaactcgagggagacagataaacagtttcttta

SEQ ID NO: 1667 - protein, 207 aa, Homo sapiens
MQHHHHHHAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 1668 - DNA, 636 bp, Homo sapiens
catatgcagcatcaccaccatcaccacgctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtccagctaaagttgcccggaaaaaggtggaagaggaagatgaagaagaggaggaggaagaagaggaggaggaggaggaggaggatgaataatgactcgag

SEQ ID NO: 1669 - DNA, 2821 bp, Homo sapiens
ccacgcgtccgcgccgcgcggcgcaggggaggcgagaggcgccccccggtggagagcctgagccccgcgcaagtctggcggcacctggcgagcggagccggagtcgggctggggaccgcggggttgaggccggaccgcggcggggtcgggggagaaacgcgcgctgccctggcacgggccccaaccccccggccgcgcggaatggtatggcccggccggagttaaggccggggggaggcggcgagtcccgcggcggcggcgacgatggggctgcgtgcaggaggaacgctgggcagggccggcgcgggtcggggggcgcccgaggggcccgggccgagcggcggcgcgcagggcggcagcatccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccggctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagtatcattccaaaataaaagtttatttaatttaaaaaaaaaaaaaaaaaaaaaaaaaaaaaaaaaaaaaaaaaaaaaaaaaaaaaaa

SEQ ID NO: 1670 - protein, 137 aa, Homo sapiens
MGLRAGGTLGRAGAGRGAPEGPGPSGGAQGGSIHSGRIAAVHNVPLSVLIRPLPSVLDPAKVQSLVDTIREDPDSVPPIDVLWIKGAQGGDYFYSFGGCHRYAAYQQLQRETIPAKLVQSTLSDLRVYLGASTPDLQ

SEQ ID NO: 1671 - protein, 109 aa, Homo sapiens [sequence omitted]

SEQ ID NO: 1672 - protein, 145 aa, Homo sapiens
MGLKSHVLPAPNSQGQGSLCIFVYVTSYMDYIQLQGKENLDCSGLNKQKIVFPHSMDSGDGWLMVLVQQLHEGRGHVLDPFALISVLVTSWSQDGCCIPKNHVCVQGRRGGGRGRAKLAGPVTFYQKVKPRQKSVSCSLPLHIFT

SEQ ID NO: 1673 - protein, 117 aa, Homo sapiens
MDYIQLQGKENLDCSGLNKQKIVFPHSMDSGDGWLMVLVQQLHEGRGHVLDPFALISVLVTSWSQDGCCIPKNHVCVQGRRGGGRGRAKLAGPVTFYQKVKPRQKSVSCSLPLHIFT

SEQ ID NO: 1674 - protein, 90 aa, Homo sapiens
MDSGDGWLMVLVQQLHEGRGHVLDPFALISVLVTSWSQDGCCIPKNHVCVQGRRGGGRGRAKLAGPVTFYQKVKPRQKSVSCSLPLHIFT

SEQ ID NO: 1675 - protein, 102 aa, Homo sapiens
MQNCVPVSFCCVTNHPQTWQLETNPVFSHNPMGWQFGLGSTGQFCCSHLGSLMELRSAVTSAGPGWSRIALLTCLAGDRLLAGIAWFSSMWPLQQASSGLFT

SEQ ID NO: 1676 - DNA, 1336 bp, Homo sapiens
ctctaagcagcatgtaacctggcctgcatccaggaaatagaggacttcggatccttctaaccctaccacccaactggccccagtacattcattctctcaggaaaaaaaacaaggtccccacagcaaagaaaaggaataggatcaagagatacgtggctgctggcagagcaagcatgaattcgatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcaggatctctctccgtggcagcagaaaatcagccatattcttattgcctgctgtctggcagtttgggcttgaacatcgtcagtgcaatctgctctgcagttggagtcatactcttcatcacagatctaagtattccccacccatatgcctaccccgactattatccttacgcctggggtgtgaaccctggaatggcgatttctggcgtgctgctggtcttctgcctcctggagtttggcatcgcatgcgcatcttcccactttggctgccagttggtctgctgtcaatcaagcaatgtgagtgtcatctatccaaacatctatgcagcaaacccagtgatcaccccagaaccggtgacctcaccaccaagttattccagtgagatccaagcaaataagtaaggctacagattctggaagcatctttcactgggaccaaaagaagtcctcctccctttctgggcttccataacccaggtcgttcctgttctgacagctgaggaaacgtctctcccactgtttgtactctcaccttcattcttcaattcagtctaggaaaccatgctgtttctctatcaagaagaagacagagattttaaacagatgttaaccaagagggactccctagggcacatgcatcagcacatatgtgggcatccagcctctggggccttggcacacacacattcgtgtgctctgctgcatgtgagcttgtgggttagaggaacaaatatctagacattcaatcttcactctttcaattgtgcattcatttaataaatagatactgagcattcaatgtgaaaaaaaaa

SEQ ID NO: 1677 - protein, 250 aa, Homo sapiens
MNSMTSAVPVANSVLVVAPHNGYPVTPGIMSHVPLYPNSQPQVHLVPGNPPSLVSNVNGQPVQKALKEGKTLGAIQIIIGLAHIGLGSIMATVLVGEYLSISFYGGFPFWGGLWFIISGSLSVAAENQPYSYCLLSGSLGLNIVSAICSAVGVILFITDLSIPHPYAYPDYYPYAWGVNPGMAISGVLLVFCLLEFGIACASSHFGCQLVCCQSSNVSVIYPNIYAANPVITPEPVTSPPSYSSEIQANK

SEQ ID NO: 1678 - protein, 177 aa, Homo sapiens
TRPRRAAQGRREAPPGGEPEPRASLAAPGERSRSRAGDRGVEAGPRRGRGRNARCPGTGPNPPAARNGMARPELRPGGGGESRGGGDDGAACRRNAGQGRRGSGGARGARAERRRAGRQHPLGPHRRGAQRAAERAHPAAAVRVGPRQGAEPRGHDPGGPRQRAPHRCPLDQRGPGR

SEQ ID NO: 1679 - protein, 42 aa, Homo sapiens
LVCCQSSNVSVIYPNIYAANPVITPEPVTSPPSYSSEIQANK

SEQ ID NO: 1680 - DNA, 717 bp, Homo sapiens
  misc_feature 22, 586, 687, 714: n = A,T,C or G
aaaagaatttttgctttctttntctctaaattttccttccgtgctttgatgcgggctcgtttctcacgttccagtctgggaaaatggtccacataaggcaaggcaaagaatcgtttcctattgtatcttttatttaggtgccaaggtataacccactgcttgaacttgtgccagatgattcttccaaagatgtctcttctccaagcaccaggtctagctctttcttgaccagtctgaagaagccttagggcatcttctctttcctggacaactttatctaatgcatccatggaatctactaccttatctaaccgctctggacttggcattggcaatctctgccgcttggcctcctgctctagggttagaagcatgtttctttctttcagtaagacataccaaagtttgtgtaaatcttcattacttttgttccttagttgctgacaggtccatgctgctccagattttactttttcttgcccccagttttttgggtcatcaaaaaattcttctagtcctttccttgacaatgtggtatgaagtaatctatattggtgaaaggatgtcacatttggtgtactcttangcaacaaactaagaaaaaaccctgtcaggcagggacctgaggagttattaacgaaccgggaagaattcagggcggatgaaactctcctaccaagaaagggncaaaccgggccgcagccatgttttccncat

SEQ ID NO: 1681 - DNA, 305 bp, Homo sapiens
ctgtacatttaacaaaatatgtgcaagactgtcatggtgaaaactacaaaacaatgataaaagaaattcaagaaaacaaataaatacaggggtatactatattcatgaattgggagaatcaatatcattattaagtctcctcagattgatctatagattcacagaaatcccaattcaaaccctatcaggactatttgtagaaatagacacactgatgataaaatttacatagaaacacaaaggaagcagaatagccaaaaattattggggaaaaaatgtagttgaaggattcccattactccttt

SEQ ID NO: 1682 - DNA, 498 bp, Homo sapiens
aaattacactccataaatttagacatatgtctctccaagtaagtacgagctgattgggaacgggctccaatggacatggctctgcagtcaaaatagttagcagatggacaggtttggaaaatgtgagggcccatatcatcataaccagcaataaggagaccaacaccatatggtctccggccatatcgttgtgttggtatctgggtctcttagactggttaacgagcttgttttaacaaggaatgaagtactgtctttattttcaaattatacattattaacaaaggtctctggcttattctttaattgttgcataatccaccagagaaataatgcaataggacactatttctttggcctaatataaaatgtttgactttctaccgaacctaagaaagagtgccagcaaaataatttcttcccatctaaaacctgatttgttttggatacaagggggtctaggatttcttgggacatctagaaccattaagaaacttt

SEQ ID NO: 1683 - DNA, 322 bp, Homo sapiens
aaaaattaaaaatagcacaattctacaattctgattttaccaagaaaataaaccttttttggcacatattatcctatgaaaatggaaagctgagtcaggctgctctgcttttcacagcacaaataagcattcatgctatcagacttgggaaattaactcggtgacaaaaattcactggaaaatagaatccttggaaaaatggggtcaggtgccatccactgagaggcaatgataatgtgtgtccttcgttattagcacaaagttaggcagcacactataattttagctacatgcaactctataggaacacatgtgggtaagg

SEQ ID NO: 1684 - DNA, 293 bp, Homo sapiens
  misc_feature 51, 182, 188, 195, 203, 220, 246: n = A,T,C or G
aaaagatgctgcttccctgttttcttccaggaacacagagaccaacacggnttcaaacacagggcgagcttctcactatttcctgggaatgttacttctcagcccaacacttctcttcccaagaagttcaagttttgagactgtttttctccccggaacagtacttaaaaaaaaaaaaatcnttgatnttcaaanatgggttnttttcgtgtcctggaanagcatcagtaactaaatatcaagttntccacaatgctgccccccctggggggctaaccggatgccaagggaga

SEQ ID NO: 1685 - DNA, 390 bp, Homo sapiens
aaattgtctaactcctatcccagtttctttttatagtctaaaaacaaggaatcacccaagtaagatactccttcagagcactgctgaaaacggatcaaacgtagagatcccccagatccctgttctcaagtgttaaaaatattttatattagcacatagaatacccttagatatattctgttatgttctaaagagtttgtgtttccccctttttgatgatgtcttcaatttcttctgagacctttcctgtatagtcatttggttctattgcttttaacttctcttgatactccagcggcaaaccattttcttttgcacccatgcaaataatctttttatactgtggggatgggggagcactttcgtaatttgtcatcagataacttcgac

SEQ ID NO: 1686 - DNA, 549 bp, Homo sapiens
gggtccagtccaacctgctcctcattattgtaaacatgtgcagaatcaatatggtggaacccggcttctattgccaatttgacggcctctagagctttacttttaggaacctgggggagcaaccaaacgtaatattttctgactaatgtgcctgagagttagttcgggcacaagcagcaacgttcacaaaaatcagcttttcctcctttcttggatgagctctgtatgtagaatcataagcccatcccagtctgactgggtctttcccatttagtaataaaggttgggcatagcaggaacttctgcagtcccagaaaaatcactgaaagtggaagtgtccccaaaacaatttcactttcagtgattttttggaaaaatcaacaggacgcaactatagttacagacataatcttaattatttttagtatggtgaaattaacacaaggaaatagccacatggaaggaattatgaaggaatgcagtgtaagctcctgtgattcctctcccaccatgttgcacagagcgcactgactttatccagcatcatat

SEQ ID NO: 1687 - DNA, 442 bp, Homo sapiens
  misc_feature 34, 50, 67, 382, 384, 385, 435: n = A,T,C or G
caactgcaaatgaagatcctttttggatacttgntgagaaagacacattngggggggggttgtgacnaaaataacgatggccggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacaggctccatgatgactatttctatcatgatgagctttaatctccgagcctgtctcagtagagtactggctccttttataatttgttaccagctttacttttgtgataaaatattgatgtngnnttttacactcttaagtcttaaccacagtcacaattatcttaatgtagatnataattg

SEQ ID NO: 1688 - DNA, 340 bp, Homo sapiens
  misc_feature 23, 52, 56, 58, 60, 62: n = A,T,C or G
ctgccagctaacagcaagagctntgagggcatcactgaacagatagcacctnatgngntntnatgattcaaaaatctcccttgctgttggatttaccaacacgtaggcttttatttcttcccattacatctgtttagccacagaaagcatcgggccatactcactgcagaagataagacttcctcagaatcttatttgtttagtgcactcaattttacttcactgtctcatcacttgagagactggttaaggcaagaaacccatttcttaacattttttttgttttcaaacatttgaaaagcaacaccaaaacgtatgcagttaattcctcaattctttc

SEQ ID NO: 1689 - DNA, 140 bp, Homo sapiens
  misc_feature 61: n = A,T,C or G
ccagagggcctgcacatgcaatttccagtccctgccttcagagagctgaaaagggggcctnggtcttttatttcagggctttgcatgcgctctattccccctctgcctctccccaccttctttggagcaaggagatgcag

SEQ ID NO: 1690 - DNA, 485 bp, Homo sapiens
gagattattacccagaattcacatgtagggatggggaaggacaatttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgttttttttctcaactagttaagtcaactgcttctgaaataactctgtattgtagattatgcagatctttacaggcataaatattt

SEQ ID NO: 1691 - DNA, 342 bp, Homo sapiens
  misc_feature 11, 24, 26, 49, 50, 51, 53, 61, 62, 142, 173, 190, 193, 242,250, 291, 303, 304, 315, 329: n = A,T,C or G
gaagaaacaangatgacttttttnanaacaaagcataatgctggcaatnnngnggggggtnnagttttccaaacatgttatcttaaatacccctttatccttacaggttgacataactttgaatgttttaacagcaagaatnttaagaaaagataaacaccattttatttatntataaaaacaaaattanttncaaatatttttgacattgtgattttttttttccacatttctcagcaaanctaatggnattttaatcattatttttgcctgtcataagaaaactcttanctgaaatggccnnaaaactgtganacatgctatggaanctgaatgccggac

SEQ ID NO: 1692 - DNA, 450 bp, Homo sapiens
  misc_feature 23, 59, 60, 409, 417: n = A,T,C or G
aaaaatggggccccaaagactgntaagagctcatccccgtggtctcctatcaccggggnnggggttcatgtctgatgagaagcttggacggtactgaaactcatacatgtaggtgggtgctccagcatctctgtggttccgggccacaatcacagatgggacaccaaacatcacatctgctatcaagtccaggaacaggtctttctttttgacagtgtcgtctgttcctcctaagtatttctcagtggcttctggaatcagttccttagcaatgcaaacaaggggataggacttccacaggagtgacatggctgtcttctggtccagttgcccttcggagagtggatagctcatcaactgcattggaatcaaccagccaaactcctgcttgttaattccgaccatgtangggacagngtggaaattcctttcagcttgaaagctcttcag

SEQ ID NO: 1693 - DNA, 436 bp, Homo sapiens
  misc_feature 20, 51, 52, 58, 62, 286, 323, 333, 375, 385, 399, 401, 402,407, 410, 426, 432: n = A,T,C or G
ctattttattaacatcatgntttaataaataactggctacttctaataaanngggggnctcngtttacaacagcccccaatattccattttgaccactctgcagaatttggtgtaaaaagttgaatgaaatgtagaccctgagctatcaagtaattatgtttcaatataaaaatagagaattactcttacaactgaagattgaacaataacacaaacaacctctttgtgggttttaggttcggtaaaattagttgggatcttaatggctgtctaaagcaggaaganacagaattttaatctttctgaagacttctgggaactnctttgaaagngatttgttaccttatcagagtttatgagctattattttggtnaaggcacaangaaaggattcccangnngttgntantcttttgccctggacnacaaanattg

SEQ ID NO: 1694 - DNA, 313 bp, Homo sapiens
  misc_feature 29, 32, 34: n = A,T,C or G
attatctgcaaggtttttttgtgtgtgtnttngnttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgttttt

SEQ ID NO: 1695 - DNA, 522 bp, Homo sapiens
ccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatgga

SEQ ID NO: 1696 - DNA, 174 bp, Homo sapiens
  misc_feature 52, 55: n = A,T,C or G
ccagccattgcctggcatttggtagtatagtatgattctcaccattatttgncanggaggcagacatacaccagaaatgggggagaaacagtacatatctttctgtctttagtttattgtgtgctggtctaagcaagctgagatcatttgcaatggaaaacacgtaacttgttt

SEQ ID NO: 1697 - DNA, 561 bp, Homo sapiens
  misc_feature 22, 55, 56, 198, 265, 374, 378, 399, 410, 465, 543, 549: n = A,T,C or G
ctgtaatgttattgcagatccncatctctcgctcaactgttaatgtctcaacctnnagaggcaccccacccagcacactgtcagtaaaggggcagattgaaacagtgagagttaagggtacagtagaaaattctgcatgtttgcagtgactagaatcagatagtagtgtggtggtttttttttttaatcattatgaanagtgggagcttgcaggtaaggcttctgtggtggtttgaaaagcagaaagcaataaatgaaacaaagngtttgtgtaatatattcctgccttgtcttcttcactcagagttgaaataggttttgcagtaaagctggaaaaaaaaagaaaacaaatgttcaaaactgtgtgtgttggngggnggaatttcctttgcttatagnagtttcagagnaactatatgttttttttcctttctttttcacaggcacagaaaactgaatctgtanataacgagggaaaatgaattgcatgaaaaattggggttgattttatgtatctcttgggacaacttttcctcggccgcnaccacnctaagggcgaat

SEQ ID NO: 1698 - DNA, 267 bp, Homo sapiens
  misc_feature 58, 62, 63: n = A,T,C or G
cgaggtctgccctcgattgtgtatttctgttggatcaaacactcccatgttaccactnggcnncataatgtatcgatatatattccaagtggcaacaggtaagttgagaaggaagatgaaccagtgcaatgacatgagcagtaatacagtgacaatggtatggccacttaaattaaaaatataacaaaattgaaaaatagacatataaccaaaaagattctaaatcttgcaaggaaaaaaagaataaagctgccaataagttatttt

SEQ ID NO: 1699 - DNA, 449 bp, Homo sapiens
tgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcag

SEQ ID NO: 1700 - DNA, 398 bp, Homo sapiens
acatttcacaaataagatgtagctttccaaacaaatccattcgatgaccattatcacaactatattttattctaatttataaaacaaaaaatggttagacaagcacatgatatcaagagtcttcaacacagtggattccattttattaagaaaaaaaatagaaaacaagtagtccttaaattgtcttagctctccatagcatacgttatataaaattaaagttttgcttccaaaaatatgtttccatgtggtcgtggtgttgtccagtgctattagggccaaagcaccaaagacatgagaagtttaaccatcgacttgtcatttttcataaaagctaaacatttccttataggtctggagtaaaatcttctaggcattttagtgctaaaagtcacttt

SEQ ID NO: 1701 - DNA, 257 bp, Homo sapiens
  misc_feature 4, 12, 13, 27, 47, 53, 61, 63, 76, 77, 78, 79, 86, 87, 88,89, 92, 93, 97, 100, 101, 103, 127, 129, 130, 133, 134,141, 142, 143, 147, 149, 152, 155, 164, 166, 174, 185, 188,194, 203, 205, 220, 228, 237, 238, 240, 241, 246, 251: n = A,T,C or G
aaanaacactannggaccttagagatnataactgtttgataatttgnctcagncgtattgncntaaaagatatatnnnnggggggnnnntcnntgtnaanngntgtttggattgcctgatattatancnnggnngttgggnnntatntnacncantatacctcngncgcaaccncgctaatggcnagnatcatnacactggcngncgttactactggatncgagctcngtgccaatnncnncgtcntcatngcccta

SEQ ID NO: 1702 - DNA, 526 bp, Homo sapiens
  misc_feature 9, 476: n = A,T,C or G
acctaattnattgaagtaataaccaaataattttcaatcttgattcaactgtgattcaaatcttacaccatttgcccacttctatgaattttatgtataaaattttttaagagtcagagttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatggttattcagaatcttctgtgggaaaagaatgtgagaaacaaggacaatcactgcatggaggtcataaggctgaagggattggtgtcaatcaacgacaaatcacaacgagtgattgtncaggggggtccatgagctctggtgatccgggaggagactccaatgagctg

SEQ ID NO: 1703 - DNA, 116 bp, Homo sapiens
gacctccgaactgagctctaatttagctgatcagattttgcttgggtaaagttcctttttaatgttctaaagtgtttacggttctcaaatatcagttaaaaactaattttaggtgg

SEQ ID NO: 1704 - DNA, 241 bp, Homo sapiens
  misc_feature 209, 230, 235: n = A,T,C or G
aaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgttttttttttttttnaaggggctttgtttttttttntcaanaaaaat

SEQ ID NO: 1705 - DNA, 336 bp, Homo sapiens
  misc_feature 9, 12: n = A,T,C or G
ggtcctgtntanacacacatcaatatgaaacaaaaaaaatttatataaataagtcaattaaacttcacaaaaactaaagaaacacaagacaaaaatccaacaagcaataaaaactgtacaatattggtcagtcttttatatctgaaaaatgtgtaacttaaaaaaaagttatttatcgtataaaaaaagtcttttacatctgtgttagctggagtgaaaacttgaagactcagactcagtggaaacagatgaatgtccacctcgctttcctttggagaggatcttgaggctggaccctctgctcacagaggtgagtgcgtgctgggcagaggtttt

SEQ ID NO: 1706 - DNA, 107 bp, Homo sapiens
agggtggctctgggagcagttgtgctgcgggcttgctgggggagaactctaactgttgcagaaacagagcttcatggcttgcttaaattacttagctggaatatttt

SEQ ID NO: 1707 - DNA, 512 bp, Homo sapiens
  misc_feature 468, 470: n = A,T,C or G
ttttttgtctggtaattatatatttattatttagcaaaactgaagaaaaaaagcacagaattgtttcaacagatgtctctcattttcagctagcatttctctcccaagttgagctggtttaatgtgttttggatttccctcctcaattggcttattttttagatcacctgcaattcatttgcaaattgcaataaaacacattttagaaaaaaggaaccttcaattattagctttgtttctttttaaatgtatatattttgactaatgtttgtgaatgaagttggctaacatgtatttagtttcattttggcggtatgtaatataaagtttttaaaattttaaatatggttttaacctttatgtgtaaatgattttctagtgtgaccttctaatttaatattagacgtctaaggtatatctgtaaattagaatccgactatcactctgttcattttttttgaacaaagngnttaaagaaagcctgaaccagggaaaaaaaaaaaaaaaaaaaa

SEQ ID NO: 1708 - DNA, 203 bp, Homo sapiens
  misc_feature 28, 36: n = A,T,C or G
aatcttctaaaggaagaacagacccccnagaataanattacagttgttggggttggtgctgttggcatggcctgtgccatcagtatcttaatgaagactataatgtaactgcaaactccaagctggtcattatcacggctggggcacgtcagcaagagggagaaagccgtcttaatttggtccagcgtaacgtgaacatcttt

SEQ ID NO: 1709 - DNA, 271 bp, Homo sapiens
  misc_feature 1: n = A,T,C or G
ngttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttcttcag

SEQ ID NO: 1710 - DNA, 239 bp, Homo sapiens
  misc_feature 58: n = A,T,C or G
tacaaaatattttaattgtaagtggtcagaggaattcttctggtttctcccttatggntatttttaatttgtacaatagttgcttctgtcaactcagcgacaatgccatcatagctttcaaatgagatcaccctgtagatcgatggactatgccttaaagttgcagatgcataaaggagactgaggacaaatggtgaaaactgtagttactgaacccaaatgttactcagagatatcaa

SEQ ID NO: 1711 - DNA, 122 bp, Homo sapiens
agtgtaagtgaacacagaagagtgacatgtttacaaacctcaagccagccttgctcctggctggggcctgttgaagatgcttgtattttacttttccattgtaattgccatcgccatcacag

SEQ ID NO: 1712 - DNA, 169 bp, Homo sapiens
ttcccataaataaaagtacagttttcttggtggcagaatgaaaatcagcaacttctagcatatagactatataatcagattgacagtatatagaatatattatcagacaagatgaggaggtataaaagttactattgctcataatgacttacaggctaaaattagtttt

SEQ ID NO: 1713 - DNA, 392 bp, Homo sapiens
tgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataaaa

SEQ ID NO: 1714 - DNA, 301 bp, Homo sapiens
tgggagggatattttcccacaggaacaagggtctccgtgatgacacggggtctctatagtcatgttgagagcctaatggcccttggcataattgctggtgttggggtagaaggtgtcttggagtttgctcaagtggttgagagggagggaggtgccatagacttggaggaactggcacgaagccaaggatacaaatccaggcagggctgtggggcaggatagggagcagggccttctactgaaggagtgactcaggaaggaggaggggaaggtgacaagcccctgggcaggagccctgtgg

SEQ ID NO: 1715 - DNA, 194 bp, Homo sapiens
taaattcaggctaacttctgaaaatcccgttttattcacctcactgtggtaccagtaactatactgagtcaggttactttacagttaactatgtcacctaaaacacaataatccattaacactctaataacagttattgggtgtggtcatactggaaattcttaaccatatagttgtcttgccaattttttttt

SEQ ID NO: 1716 - DNA, 185 bp, Homo sapiens
gtaggaatgggttcttggtacacaagatagtattgttgagctagttttcgagctctgtgcacaagcactctttaattcccacggacggggctcctccagctacagcagccaaagcatattcaatctggacaagtttaccagacgggctgaatgtagtcagcgaaaaactgtacccgcgctccgcc

SEQ ID NO: 1717 - DNA, 296 bp, Homo sapiens
  misc_feature 3: n = A,T,C or G
aanaggctcttggtggagaggactgtgaagccgtcggcaggtgtgccctcggttgtgccgtcggcgctggctgccttactgacttcaccctgcttcttcttggatttccgggcccctttcttgcctcctgcttttttagatgcaggcttcttctgggatggagacttggcctttttggctgggggtggtgtgatgatggcttccaactttcctttggatccccgcttcttcgctagcaactcggggtggatgttgggtaacacacccccactggctatggtgactccttttagcag

SEQ ID NO: 1718 - DNA, 343 bp, Homo sapiens
  misc_feature 208, 322, 341: n = A,T,C or G
atggcattaattgttccttgcttttatagggtgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattntgaatacacatctctgtcagtgtgaaaattcagcggcagtgtgtccatcatattaaaaatatacaagctacagttgtccagatcactgaattggaacttttctcctgcatgtgnatatatgtcaaattgtcangc

SEQ ID NO: 1719 - DNA, 193 bp, Homo sapiens
tcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggacttcctccgtcaggcag

SEQ ID NO: 1720 - DNA, 176 bp, Homo sapiens
  misc_feature 30, 91, 145, 168, 170: n = A,T,C or G
tgattcagaattttttttaatgaaaggatnattgcactaaccttcttcctgctgctctgattctgcatttgtggtacttgtgactacgttntttcaaatatagatagatttaagctgctaatttttttttttttagtaaccactnctatatcatgtcttttactctgntnataata

SEQ ID NO: 1721 - DNA, 128 bp, Homo sapiens
  misc_feature 9: n = A,T,C or G
tattcttangaaacttccctaatcccttggaaattcccgggtccttcaagaataaaaaaaaaagggtcaagaagaacaaattaccaaagggaaagaatggctttcaatataataaggtccatttttta

SEQ ID NO: 1722 - DNA, 285 bp, Homo sapiens
  misc_feature 34, 140, 165, 170, 230, 255: n = A,T,C or G
ttatgaagttgacaaataaataaaaggtagtggntatgtctgagcttattgtgtttgagctaacaccaggttactcagtaaccatgacctgctcctccatttccatttattctcaacattaaatagttttatcttgttgntgccagaaatgcacttgtgccaggnattgnccctgctgtatgaaaagcttcttggcaatgaattctgtaataagtgccctacattatggntttctggtggaattggtttaacagngacaacccaggatttccaatatatttttgt

SEQ ID NO: 1723 - DNA, 536 bp, Homo sapiens
  misc_feature 33, 66, 67, 68, 406, 437, 450, 462, 498, 515, 516: n = A,T,C or G
cttggcttgcaggtggcaccttctcactatgtnctcacatggccttttctctgtggagagggacannnagcatgagcaggctctggtgtctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctccccttcagaattcccgcccccacccagggatggggaagaggagcagagaggtatgggaagcagacacggagagtggcaggtaccatgctggggtgggctcaggagtgctttcgganggacatatggaactggcagggctcaatgcanggagggcggaagnccttgggaagancccgtggcctgagaaaggggctgggctacaaccctnggcaagttactttaccnntgaccttcgatgcttttggg

SEQ ID NO: 1724 - DNA, 145 bp, Homo sapiens
  misc_feature 4, 12, 27, 32, 45, 47, 48, 59, 61, 65, 93, 98, 103, 121: n = A,T,C or G
ctgnccttttgnaacaggaccctcacnctatncaatggggggttnanntgaagcatgancntatncatgcggaaaacccaactcatgtgagcncaaancggancgacccagacaaccatgnatgcggctaatatggggagagaaa

SEQ ID NO: 1725 - DNA, 173 bp, Homo sapiens
caattctggaattacccacttgtttaattttgagcaacatgatctagcattaatgtagtcacattctaaatcagacaatgtaattatgaagtagaccgagaggaagatgagcgcgcaacaatcgaggagagagaagacgaacaccaccgcctccatcctcctcctccgtcgcc

SEQ ID NO: 1726 - DNA, 302 bp, Homo sapiens
acccgttggaaatgggccatggtctaatttggtgttgaaataaactaacctctttggctgtttctcccaaactgccaccagccaggcaaggccaatccaatactgactgctggctgggggagctcgtaatgggtgatgccgccctgctttttgcatatgtcaggctaacaggtgctttatttccagagaattgttaatgcccttttttgaaaagagcagcagaaattccggacaagaatctgaaaaataggtgtcaaaaactatttcccagaaggtagctgtacaggagtttgagtctccag

SEQ ID NO: 1727 - DNA, 274 bp, Homo sapiens
  misc_feature 3, 4: n = A,T,C or G
ttnngttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttcttcag

SEQ ID NO: 1728 - DNA, 415 bp, Homo sapiens
aaatccctttctgcttccactggaggcaaaactgaacaaaatgttagttaaatagagagagcagcatttctaagaaatctgtggtcagcattatagaccatctatgctacaaggatgtcattaaataggatttgttcaattactggattcttcttctatgatcagttatagaatttctggtttatatctctgattcataaaactgggactccactttttgaagatacatctgattgatttttttcagtcatgatttaacagacttctttgagatgctcattttaacatttacataatttataatcccaaatgtataaaagacaatgaaaaaagcatcataaataaataatgcaaaatgaaatagttatgtcagacttttggaccttctgataaattagcaaaactgtaacagaaa

SEQ ID NO: 1729 - DNA, 309 bp, Homo sapiens
  misc_feature 4: n = A,T,C or G
acanaccgtatactttatgcaaacaaagtgatgcctcactgacttaggagacaagtcacatgccatcagtgtgtcagaaaatttctttcttcagtgatagttaaggtaacctcgccagctactttccagagacagctccagggcaatactggggaaaaaaaaatcagagacataggaccccaatagagccctgtgcaacaaaaagatgctagataacaaaactcaaagcaaaactaagatcattccaatttaggggaaagtttttttattcagtgtttaagattaaaaactacaagattttgcttgcag

SEQ ID NO: 1730 - DNA, 285 bp, Homo sapiens
  misc_feature 2: n = A,T,C or G
anctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgctccatgggagagtattttagagacaatggcaaacatgctttgatcatctatgacgacttatccaaacaggctgttgcttaccgtcagatgtctctgttgctccgccgaccccctggtcgtgagg

SEQ ID NO: 1731 - DNA, 244 bp, Homo sapiens
cattaccttgctaaaatttccactaagctacagcttcagatatttacaagaaaaataaatatcttttaacagacttcaatgtggtttaacagcaagctagctgaggagttgtattttgttgttatttcaggtaactttttattaagaaacagttaatatttcagcgattacaatttcaggtgttcaaaactcaagaagggtcatcattatactctgaagcagaattcttcaggtactcatcttt

SEQ ID NO: 1732 - DNA, 272 bp, Homo sapiens
  misc_feature 9, 65, 192, 210, 212: n = A,T,C or G
ctgggaagncagttcgttctctcctctcctctcttcttgtttgaacatggtgcggactaaagcanacagtgttccaggcacttacagaaaagtggtggctgctcgagcccccagaaaggtgcttggttcttccacctctgccactaattcgacatcagtttcatcggaggaaagctgaaaataaatatgcangagggaaccccgtttgcntncgcccaactcccaagtggcaaaaaggaattggagaattctttatgttgtcccctaaagat

SEQ ID NO: 1733 - DNA, 388 bp, Homo sapiens
  misc_feature 2: n = A,T,C or G
anttggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatgggaccatatttattacagttttt

SEQ ID NO: 1734 - DNA, 282 bp, Homo sapiens
tttggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacggaaaataaataaatcaacaaatgccccatttttgttttccaaaaaagatcactggcaactaacaatttt

SEQ ID NO: 1735 - DNA, 268 bp, Homo sapiens
  misc_feature 1: n = A,T,C or G
ntaagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaattttttttt

SEQ ID NO: 1736 - DNA, 478 bp, Homo sapiens
  misc_feature 2: n = A,T,C or G
tnatagacttttccaatggcccccttataacaccagaaaggattgtaatcttgggcgtattttgtgctggcatctttggcagttgtgaagatcttgtaccagagcgtggcgttgctgtacgtgtcaggaacacagtgcggtggctgtacagtgacggggaacaccccagggctggccgtgagggtcatgcaggctgtgaataccacctgctcacagtgaccgtggagggcgcagtcatctgagctccacgctgtaggcagggtgaaggtgatgtttatctcctcgtgggcttccctgcctgaaagtccaatctgatgccctaagatggttgagtacagatgggtgacgttgcgggaataccctccgaagggtttcagtgggtccagggttagggtgattgagactgagatattcaccgggcccgagtcctccagggcctggggggactgggtggaagctcgggcctgcccgctggtca

SEQ ID NO: 1737 - DNA, 489 bp, Homo sapiens
  misc_feature 5: n = A,T,C or G
ctttnaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttgg

SEQ ID NO: 1738 - DNA, 262 bp, Homo sapiens
gttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacacggatcctggtgataagagaaattcaggaggccatcgcagtgg

SEQ ID NO: 1739 - DNA, 422 bp, Homo sapiens
ccaccatccttttgagacagttcctatcaacaatcttgaaccatactaatacattacttgttcctgaagtccttttgttgtagctcataataaaataagcaatacaaatgaattatctgtatttaagggaaaagaaacatttacaagaaaacacaaaaatataactgttataattcattatgaataaatatacactttgaactggctaagtacaatctttatacattgtttaagatttaatacagtttattagccattttcttttttcacacaatgtatatcaaaattaaaaaaaaatactgatttatagaaaaatggcaaagtacagtagttccattccaatttgaagggccatgaaaagccactgcaagaccttttagcctaattcaaacctgtaaacatgttcagtcttttttacctgc

SEQ ID NO: 1740 - DNA, 92 bp, Homo sapiens
gctaaatacctatctaatgtgctatgtttatcaaatcgtgtactaaaatggaaagctagttttgagaaattattcagaagccttgttatttt

SEQ ID NO: 1741 - DNA, 188 bp, Homo sapiens
tttcaattcttccaaaaggctcaaagatcccacgaagcatatcttcagttatgttgaagtgtaatgagcccacataaagcctcataggtccagcacttcccttttgtaaattgtttgccattgctgcagctctgtttttttctgcctgtgatgcctgtactatgattggcacgcctaaaactcgttgg

SEQ ID NO: 1742 - DNA, 285 bp, Homo sapiens
  misc_feature 3: n = A,T,C or G
ttnaaaatactttcaggctccaccaaaacgtagaactgaaagcatgtattttggaagaaagagatacattttgtatgctttcttttccttttgtagattcccagtttattttctaagactgcaaagatcactttgtcaccagccctgggacctgagaccaagggggtgtcttgtgggcagtgagggggtgaggagaggctggcatgaggttcagtcattccagtgagctccaaagaggggccacctgttctcaaaagcatgttggggaccaggaggtaaaactgg

SEQ ID NO: 1743 - DNA, 117 bp, Homo sapiens
  misc_feature 2: n = A,T,C or G
angatctatagacactttaggcaaaacaggctcataaagcaattaaaaaatcaacaatttagtaaaaacaggctacatagtattttgtttttacgtttcatttgtctattgatcttt

SEQ ID NO: 1744 - DNA, 111 bp, Homo sapiens
aaacaatgggctaaaaataaacagtattaaaaggttaagtttatataatacatatgtacacaattagtggtgttttcttttcagacaaaatactgaaacaaatattagttt

SEQ ID NO: 1745 - DNA, 305 bp, Homo sapiens
ctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgcgaccatcccgtaccggcccaagccgtccagctctccggtcatctttgcaggtggtcag

SEQ ID NO: 1746 - DNA, 319 bp, Homo sapiens
aaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaa

SEQ ID NO: 1747 - DNA, 177 bp, Homo sapiens
aaatccttttcccataaataaaagtacagttttcttggtggcagaatgaaaatcagcaacttctagcatatagactatataatcagattgacagcatatagaatatattatcagacaagatgaggaggtacaaaagttactattgctcataatgacttacaggctaaaattagtttt

SEQ ID NO: 1748 - DNA, 237 bp, Homo sapiens
  misc_feature 9, 12, 15, 25, 172, 225: n = A,T,C or G
ctgaaggantgnaantagactggtngagagaggaaggcactgagccacatgaaggtatgtacgtaggttttgttcagtggaaatagactggtagagagaggaaggcactgaaccacatgaaggtatgtgtgtaggttttgttcagtggaaatagactggtagagagaggaangcattgaatcacatgaaggtacgtgtgtaggttttgttcactgacttcttcantgtctcagccag

SEQ ID NO: 1749 - DNA, 244 bp, Homo sapiens
  misc_feature 87: n = A,T,C or G
aaaaggccccattatctgacaaaatagatggtgaacatgcactatcccaggatatctattattatccaaagaagtgtttctcaaagngtggtccatggtactggtccatgaattggttgctaccagtcaatgaagagataaattacttgcatcagagtgtaaatcaatacattgctttagctattaataaaattttgctaaaaaatcaaatcctgtcattgacctaaaaagtatctctagattt

SEQ ID NO: 1750 - DNA, 289 bp, Homo sapiens
  misc_feature 247: n = A,T,C or G
aggccagcctccaccacgcacggcgaaaggagtgaactagctgggacacacacacgtgtgaatgcatgcaagcattcactgcatcttctccgtggactccctaccgctcttccatagccccccctttcagcctcactgtttctcgtgtgagcctatctgcttgggcagtccactcgggagggggtcatggagccaggactccctctaaataggaatggaaaggaccctgcagatatttttatcctanttgtgaaaacaaggtgcctctgattctctatatccatcacag

SEQ ID NO: 1751 - DNA, 594 bp, Homo sapiens
  misc_feature 558: n = A,T,C or G
ctggttattaatcacaagtcctggaaatggtctaatgaccgtgaatttgataaactcggcagagtctaagatccttctcatggagctgatttccaggtagctgggggctttgaaggacacccccgggggcatgccatcaaccaccacacagccagggttaattgtgattttcctgtagggaactttcacaggaaaacccataccaatagcttcaccaaatttccgactaaagaggtcattcacttgttctcttagctgtctagctttttcaactttcgagagtctttcattatcatcatctggaattgtcacctgaatgatgttaaggtcttcaacacctgatgcagtagtattaacattgggtgatgaatttatttttctgggagggctcttagaggaggtgctctccttaatcgccgtctcaaacatttcgggctttttaatgatgaacttaattttggctttgtttctgagtatcttctccagcctcggaatgccaaaagtcgatggtcttcggaatggcacaccctcaggtaagccttccacataaaagtcttncgggaaagactcaaataacgcgaacggcaccttcac

SEQ ID NO: 1752 - DNA, 311 bp, Homo sapiens
ctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaatttt

SEQ ID NO: 1753 - DNA, 587 bp, Homo sapiens
  misc_feature 552, 561: n = A,T,C or G
ctgtccattatacaccgtcacgttgatccctgcctccagcaactcgtccacaatgctaatgactggcttcatgaagtcctcctccatgttcacaaagacgttggtagcctggcctccccaggattgatcctcaggaataattttgagcttctttctgatggggccattcatgagctggcttaaggcatctcgttgtaggtgtctcacgtggcgctgacaaagacaaactaggtggctctgtgtgaattctagactcgactccattgtagacgtgggagtgcttttagttaagatgttatagaagttcaccccatctgtgttctgttcaatgatcatttctgctttcccccacagctctgtggcctctctgtagagccccttatttacggcattcagtacttgctctgcaaccttagacacctctgccagacctttgtcttcgagaagagacatgctgtacaggtaaggtccccaggagagcaccgaatcaacaggggagatccaggaatcacccaaggcaacccccgcaaagttgcacttgatggtccctcnctgaatggncttataaagctctagaccaatgccag

SEQ ID NO: 1754 - DNA, 564 bp, Homo sapiens
  misc_feature 409: n = A,T,C or G
cctctctccttggcttgcaggtggcaccttctcactatgtcctcacatggccttttctctgtggagagggacagagagcatgagcaggctctggtgtctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctccccttcagaattcccgcccccacccagggatggggaagaggagcagagaggtatgggaagcagacacggagagtggcaggtaccatgctggggtggctcaggagtgcttcngaggacatatggaactggcagggctcagtgcagggaggcggaggccctgggagagccgtgtcctgagaagggcctgggctacaaccctgggcaagttacttcacctctgagcctccgatgctctgtgaaatggaaggaatgtgcttgcctgtcag

SEQ ID NO: 1755 - DNA, 214 bp, Homo sapiens
aaatgtgatgttttgagcatcaaaaagctactatctaaaaggattagtctcccagtgttcttggtaaatggggaaggttaggaaggaggcaatgatccaatgaatatagaagaactggccgattcacaggaaacttgctttggataaggtgagtcaatgggtgatattgtgcaggcagggagggaaatttctttgtacaaattcatgtccctgg

SEQ ID NO: 1756 - DNA, 225 bp, Homo sapiens
  misc_feature 8, 9, 40, 41, 76, 88, 89, 91, 100, 143, 181, 188, 197, 201,202, 217: n = A,T,C or G
aaaattannacatacatggtcaggcagcttctgtccatanntaaactattccttttcagtctgagtaatatgcggnttgttcttaatnncncacattaanaatttatttagattggtgaaactatctttataaaaaaaaaatncgaacatgaatgcaaacttaccaaacagagcccactanattgatnaagttaatnccannatagtttgccatganctgggtgg

SEQ ID NO: 1757 - DNA, 282 bp, Homo sapiens
ttgcagcctgcgatgacacagcgaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcag

SEQ ID NO: 1758 - DNA, 473 bp, Homo sapiens
ctgaaacagcttttcaagctctctctcctcgtcaaggatcatgagaggcactccactcaaggggaggtgcgcaatctggtgctcttcaggcaggtcaaaactctcaaagtctagaggattgaagggaaagaatttttctatttctggataggcatcatctgaggcaggaacagagctttttgctttaacagtcttctcagtcatctttttggcagaaaagcttggctgtttttgtttgaggggtcccttggtctttacagacttttctgtagctctgttgacagttcccaaagcctttctagtagctttaggtaaggctggtggggcatcgaacgttttgccaaaacgtggtgttgaaacttgagatctcccatctaaggctttgattgaaggtccagaccccagcttcagcccatccttagcaaccacacgggtgcctggttctccattttccttatcgacatagatcagag

SEQ ID NO: 1759 - DNA, 187 bp, Homo sapiens
aaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgttttt

SEQ ID NO: 1760 - DNA, 564 bp, Homo sapiens
cctctctccttggcttgcaggtggcaccttctcactatgtcctcacacggccttttctctgtggagagggacagagagcatgagcaggctctggtgtctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctccccttcagaattcccgcccccacccagggatggggaagaggagcagagaggtatgggaagcagacacggagagtggcaggtaccatgctggggtggctcaggagtgcttcggaggacatatggaactggcagggctcagtgcagggaggcggaggccctgggagagccgtgtcctgagaagggcctgggctacaaccctgggcaagttacttcacctctgagcctccgatgctctgtgaaatggaaggaatgtgcttgcctgtcag

SEQ ID NO: 1761 - DNA, 413 bp, Homo sapiens
ctgtcttctcatctatcttagcataggagtcctctgctgccttttcaataccgtcgtggtatttctccaaagcagttttcaagtttagaaatatttcctgggacttcagtttctccctttcagcagcatcttttagttgttgaattccaagtttaattttttggatttcttgattaattgtggttactcgttcatagacagcacctcttttttcttgaactttattgcaatcctcaattactgtgcgtttgtattgcttaacatcttcatgcttcttatttattttgaattgtgctgtggcaagtttttccttcttcacaatcatcagtcttttgaacgaattttcttcagtcttcaatttcttcagttctgactcatcactctcaatttggtcctccaagttcaggcttctg

SEQ ID NO: 1762 - DNA, 315 bp, Homo sapiens
ggaaaagaaagagctgaaaatgcagaaagccgaagagttagaacttttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgggccatgg

SEQ ID NO: 1763 - DNA, 114 bp, Homo sapiens
  misc_feature 16: n = A,T,C or G
cgaccgcctaagagtngcgctgtaagaagcaacaacctctcctcttcgtctccgccatcagctcggcagtcgcgaagcagcaaccatgcgtgagtgcatctccatccacgttgg

SEQ ID NO: 1764 - DNA, 114 bp, Homo sapiens
  misc_feature 25, 33, 38, 53, 62, 71, 81, 83, 93, 102: n = A,T,C or G
ctaatacgactcactatacggctcnagcggccntccgngccgggggctgctcnggttagatngacatgaanaccctacagntnccactgtggnaattgaaantatccctcatgt

SEQ ID NO: 1765 - DNA, 485 bp, Homo sapiens
aaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttccttttt

SEQ ID NO: 1766 - DNA, 389 bp, Homo sapiens
aaaaacaaagtcttcaacttgggtgttgagattggcaaaaggggaagcaagggaaaagccaaggaaagataaaatattcagaagaaagtcaaagttatctgcaattacatgttagaacagattttgcaggttaaaaagatgttgcttaaatatattcataaacctgttgtaagattttcacttatgcagtttcagaaaatttagctgcttaacatatgacagaactgtattttaacaaatgacattaaaagtcaggagagctactcagttaattgataaagtagaggcaacgtgggggagccctccccacgtttattgaagatttgtggctcccccagccccgtttgcctgcatcaggctaacaacctcattcctcccatagagcctgg

SEQ ID NO: 1767 - DNA, 176 bp, Homo sapiens
  misc_feature 16, 20, 21, 35, 119, 125, 133, 142, 165, 169, 176: n = A,T,C or G
tttttcaacgattaanaatnntcattacataactnggtgaaactgaaaaagtatatcatatgggtacacaaggctatttgccagcgtatattaatattttagaaaatattccttttgtnatactnaatatcancatagagcnagaatcatattatcatacttatnatantgttcan

SEQ ID NO: 1768 - DNA, 384 bp, Homo sapiens
aaaagaaatcatggtacttcttagagcaatttgcaaaaggggaaaaaagtcttaggctcactccttggaaataaatatcaagtaaccataaaaatattcagccatttttcagttattcggggagttcaggcatggtcccacgcagagcatcagagttcctctttgaaataacccagctttgccaatgacatctcttttctcaactgcataacctcccaaaacatctgatcaacatcctgctgtttcacaagtccctgctgaatgtatcgaatgtatgtaaaaaagttacatacagaagtgatcctgtatctgcaaaaaggagaaatacaataatagttgcttgagtcccctaatttaattctgtgtttacaggacttactctgg

SEQ ID NO: 1769 - DNA, 111 bp, Homo sapiens
  misc_feature 91: n = A,T,C or G
aaatataaaaaattaaaagttaaaactctagcccttcagtgaaggagacgtaaaatggcgtgggtaacaacaactaccaaaaaaaaaaaanaaaaaaaaaaaaaaaaaaaa

SEQ ID NO: 1770 - DNA, 225 bp, Homo sapiens
ctggctgaaggggccgtggagctcccgccagcccacgattagctgggccttcttcgggccaatgcgctgaagactgcggagatctcgggctgagccttcgttcagcagatccagtattttttggcgcccatgagccagtagctccgggctgatctgtagctcccagcagtcctcagccttctcctcaggctctagggcatccagggactccagctttctcttccg

SEQ ID NO: 1771 - DNA, 223 bp, Homo sapiens
  misc_feature 39: n = A,T,C or G
ggccaagtaaaagctttatttttttaaatgaaaactacnaaaggcggggtgggttgtggcgggggcaagttgtggccctgtaggaccttcggtgactgatgatctaagtttccggaggtttctcagagcctctctggttctttcaatcggggatgtctgagggaccttccgcggcatctatgcgggcatggttactgcctctggtgccccccgcagccgcgcg

SEQ ID NO: 1772 - DNA, 419 bp, Homo sapiens
ccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggacttt

SEQ ID NO: 1773 - DNA, 172 bp, Homo sapiens
  misc_feature 3, 42, 66, 68, 77, 85, 104, 140: n = A,T,C or G
cgngcggctgcggggggcaccagaggcagtataccatgcccncatagatgccgcggaaggtccctnanacatccccnattgaaanaaccattagaggctctganaaacctacggaaacttagatcatcaggtcaccgaanagtcctacagggccacaacatgccccctgcac

SEQ ID NO: 1774 - DNA, 525 bp, Homo sapiens
ccttcactctcccctgaggctgtcctggcccggactgtggggagcacctccaccccccggagcaggtgcacacccaggtaagcaggtccaggggctggggtgggcagggctagcttttggatcctgagtgtcactactctctcctcccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctggtccctttattgatgtcatccagggtcttaacgcccctgaggctgagccctgctgcagaacccacgctcctggccttgggccagcag

SEQ ID NO: 1775 - DNA, 458 bp, Homo sapiens
aaattttctagtcaaattaataagcctttgtattatatgccatcctcctttggaatgatagcggtataattaaaatagaacatttttaacacagaatacttattggtgaagtggtctcttatgtagtcttcttttgacgagaacgttgagattttcgaactttcagaactttctttttttgatgttttttcccattcttttgctttttcttttggctgacctgtttctcccactttttaatcagttccttcacatctgctgaatctgggtttagacatgtttgaactccattcttcagtgtagcaatgatttcaattttctcgcaggaagggcttggggcaaattgtttaaggtctttcaaggattgtaggtggatagtcccttggttggtgctgatgcaggaacagcgaccctttctcactactggggttccttgcactccaatcagaaccagcaag

SEQ ID NO: 1776 - DNA, 461 bp, Homo sapiens
aaagtttcacttccctagcaaaatatcttcagtcaagaaattagtctttgaaaattatgaaaattgttgtgggaaatatttatacaaattattactgataatgcacatatattttgaaacattgtttctagaagcaataaaatataacctatttaggagataacccaaatgatttgtaaaaaaattaacttgtagaaaagggaaggatgttgtgtaaaatcaagtcaattatttgaggtttttataatattgagtacttatgtactaagtcacacccagccagtcaataactgagaaatcaaaataaaataataatttcaaagaattacataaatacagggccttttgagatttttggcaattgtaaacaaaaacgaatggtttttacaattcagtgtaattctacgaatatttatttggcacccatgttaggcactgaggctacacagcagtgaaatagg

SEQ ID NO: 1777 - DNA, 368 bp, Homo sapiens
ccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaa

SEQ ID NO: 1778 - DNA, 554 bp, Homo sapiens
  misc_feature 211, 416, 499, 518: n = A,T,C or G
cagttatgcgaaaacatggctgcggccggtttggcccttctttgtaggagagtttcatccgccctgaaatcttcccgatcgttaataactcctcaggtccctgcctgcacagggttttttcttagtttgttgcctaagagtacaccaaatgtgacatcctttcaccaatatagattacttcataccacattgtcaaggaaaggactagaanaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagatanggtagtagattccatggatgcattagataaagtggtccagggaaagagaagatgccctaaggcttcttcagactggtcaaganagagctagacctggtgctntggagaaagaagacatctttggaaagaatcatctgg

SEQ ID NO: 1779 - DNA, 379 bp, Homo sapiens
  misc_feature 42, 378: n = A,T,C or G
gtcttggctgggcatgacaaccgcgtcagctgcctgggcgtnactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgagaccaagagcacaattcccattgagagaaagatctctgtgctgtaaactaaaacaaattgtgcattccttccggggccatcgtctttgtcttcttttttgtcttgaatgaattnt

SEQ ID NO: 1780 - DNA, 222 bp, Homo sapiens
ctggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatctttt

SEQ ID NO: 1781 - DNA, 292 bp, Homo sapiens
ctgctggagcaagccctgcggaagcacaacgtggctgagccgtgttccatcaaagtccttgacaaggctacggtaccaataataaagctcacagatcaggagactgaagtgaaagttgacatcagctttaacatggagacgggcgtccgggcagcggagttcatcaagaattacatgaagaaatattcattgctgccttacttgattttagtattgaaacagttccttctgcagagggacctgaatgaagtttttacaggtggaattagctcatacagcctaattttaatgg

SEQ ID NO: 1782 - DNA, 381 bp, Homo sapiens
  misc_feature 132: n = A,T,C or G
aaaacctggacctttctggaagggcagcatataaaaacatcagtcccgaggaggggacaacaatactacctcactactacatctgtgatgactggttgttcaaacacaatggagtgtgtaaggtatatgttntataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgcac

SEQ ID NO: 1783 - DNA, 127 bp, Homo sapiens
aaatatctatgtcacagcaaacaggtggcaattcaacatccagggtcgacagaatgcttgaaggagactgcaacagattggattcccatggtggagagggcatcttcacaggtgaaggggggcccag

SEQ ID NO: 1784 - DNA, 259 bp, Homo sapiens
agcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaacctttttt

SEQ ID NO: 1785 - DNA, 400 bp, Homo sapiens
ctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataaaa

SEQ ID NO: 1786 - DNA, 372 bp, Homo sapiens
  misc_feature 239: n = A,T,C or G
aaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttatagttttcagtaacttaaaaagctaacatgagagcatgccaaaatttgctaagtcttacaaagatcaagggctgtccgcaacagggaanaacagttttgaaaatttatgaactatcttatttttaggtaggttttgaaagctttttgtctaagtgaattcttatgccttggtcagagtaataactgaaggagttgcttatcttggctttcgagtctgagttt

SEQ ID NO: 1787 - DNA, 86 bp, Homo sapiens
  misc_feature 22: n = A,T,C or G
atgatgattactttcacatcgnaatccaacctgaagagtactttgttctccaatgttgctgtcaacattcagccatttatccttat

SEQ ID NO: 1788 - DNA, 354 bp, Homo sapiens
ccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagttttt

SEQ ID NO: 1789 - DNA, 651 bp, Homo sapiens
taaagggcttcttgcttttttgaatacaaaacatgatctattgtaataaaaaggtaagacattgattttacaaaattatatttccaaatacagataaaaaaatcttgaacagttaattcagattttattgatctaaaatgtgcaaaatatctgataatacttaagtttattaaattcattgtacataggctgatatcatcccatacaaaaaaatgctcagtatcttgttaagattcaaaatagtgtttaattatctgagcttaagatttattgaactactatccaaataacaacaaaagtccatattgtaaaagaaaaaagtaaaactaaaaattttctgattattaattgacttgaaattcattcccattaaaacataaaactatagccaatatccatttgaaaagtgaagaaaaactggaagtccccatgataaatacaccaattccaaataaaaaattaaaatcaaattttgctattcaaaacacacatgatcttttaagttattcaggtttaatagatttactaaggatagagttcatagagcatgtatttggtacttctgtttagactcaggttttgcaaagtccccaagagaaggtgagaaggtaaaataaacataaaattgggatccttctctcccaccacacc

SEQ ID NO: 1790 - DNA, 388 bp, Homo sapiens
aaatcatgtttaacacagtgtacacaagtcagtccaacagttagtgttaattactaataatatatgaaaaccctgccaacacaattgctgctacatcaccaatataattattaaccactgtcggaaaaacacacataaattcaggtaagactaaaagctgtctcacaaaaagaaaaaagaaatccaatggatccactaatgctatcaaaagggacatgcaggaatgtaacatgacatttttagaaatgtgtgtttctaaaaagaaaaaaaaatacactaaaatgccagtggactataattcattcaaaacatctttagtgttccttcccaaagatcttgatctgctcagtaattgcttcacaagatctatcacagccatcttttggag

SEQ ID NO: 1791 - DNA, 2442 bp, Homo sapiens
cgggagcttgaaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacttgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgtcccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaacctttgtagcttttagctgattaattagaaaaattaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatattttt

SEQ ID NO: 1792 - DNA, 2279 bp, Homo sapiens
cccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaattacccattctgtttccacaagcaatgtaattggatttactaagcatgtttatgttcagcgcctaaactctactggtgggcgctctcagtactcctggtttcaatctgtacgtcattctgctttccgagctagtttttcagagatactagaaggaaatactgatttttcaaatttcaaaaaagttctttccaagtcatctttgacatttgtgaagaattaggagatttgccaaccactaatggaaacaagcctcatgaagtttaatggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgttaaaaaaaaaaaa

SEQ ID NO: 1793 - DNA, 1904 bp, Homo sapiens
gggaatttgaattggaatttacttccagctgcactcatgcaagaatttgtgatgtatactaaaaaataaaaaaaggctcattcaggagagccttgtactcagcaagagtggctaacattagagcatacagactatgtgattgtataaggcatggagagttaaacaacctccagtcagctgcctgtttgaataccactgacttgttaagaatgatcttgcttttagattttaccatattcaaacttattaggtgagccttatatagcatatatacctggctgctattgtggggtttgggaacatgaggggtggggtgaactgttgttgttttaggtttcagtcagacagacatccctgtgcctcagttcccagaagcacagcaggcctctaggagcatccgtgggaacggcgcagtcctgacatcaccaactctcctgctcaggctcatcccatatacagaggtcaaagggtggggtttgatatcgggggaaggaatgagaaagtagaagcaatgtcacttcagtgccactgttgactagtctttggtgcttatgtcagtatttgttttatttcctgatttttttaaagttggcaaaactacatatttttatcttgatgaaggcagtgggagggtggaacaaaaacaagccattactgctatttctagttcatttactggagactgtcccttaatagctaatgtagaataaatttgaaacatagacctagatgacaaaaagaatgggaatagaaatgaatctcaggatttgaacaaacagaagacgtttatgctgtgttgatgcccagttctacaactgctattacatttgtcattctgtctccccttttcccctaattcttttatgtatgtatgtatacagtttgaggaaatgtgcatctatggtcagtcctttttaaaagacttaatgaatttattactcttttgcaaaaaatatacccactgcttatatgggcatacaaatgctaccctattttaaatgtaggtggcgtatgtgttcgtgttttaatgtattcagagccattgggcaataagcagtccagaacattgaaaactcaagcaggtaaagcacctaacacccttagtttctagaattactttaaaaaacttttatattgctgcatcttccacagttctttgggtagtctctgaacttaaaatttgtaggagttgtagactacctaaatttttaagttatggtatttgttcataggttgtaggggtaggtaaagaaggaaacagacaagaaaatggcttcttgaggtggcagctgctgagtggctaaatcttaccactttctttctactttttttggaaattttcccagcttagcatgaacatggatcatacagtgtttgattttatgtgattgagatttttgttttttatttttggagggaaggtcttggagaaacattaaaaagttggtgtatgtgcaaaaatacgaaatgttaaacaaaggaattttttcttatttaatctgaatggtaagcaagaactttttctatatacccttctgctgcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctggaaataaaaaaaaaaaaaaaaa

SEQ ID NO: 1794 - DNA, 2881 bp, Homo sapiens
acagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttccgagtttccccagaagagaatatgggattttttttgacatttttgacccatttaataatgctcttgtgtttacctagtatatgtagactttgtcttatgtgtcaaaagtcctaggaaagtggttgatgtttcttatagcaattaaaaattatttttgaactga

SEQ ID NO: 1795 - DNA, 422 bp, Homo sapiens
  misc_feature 295, 378, 390: n = A,T,C or G
gttttaaagcctctggacagagcagtatttcgtttaaaactttgtttttcttaaaagcttacagtgtttggctaattctcctcccctttttacaagacgggggccggagggtggacactggtggcaggttaagggatactgtcactttaagaagcctgcagattgaagtgtaaacatggagaaattaggggctgattttttaaactgtgtgagatattaaccagccgccctgttataaaatcaggaaatccaaacagcgatttacaccgattaacaccccctttatatatttttnacaaaaatacactgagaaaataatcaaacgttttcatctctcttgtctttttttgttttttaaaagtgtcaaaagtctacatntaaatataaaanattaaaagttaaactctagcccttcagtgagg

SEQ ID NO: 1796 - DNA, 797 bp, Homo sapiens
agtctctgctcttcccagcctctccggcgcgctccaagggcttcccgtcgggaccatgcgcggcagtgagctcccgctggtcctgctggcgctggtcctctgcctagcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccttgggcaatcagcagccttcgtgggattcagaggatagcagcaacttcaaagatgtaggttcaaaaggcaaagttggtagactctctgctccaggttctcaacgtgaaggaaggaacccccagctgaaccagcaatgataatgatggcctctctcaaaagagaaaaacaaaacccctaagagactgagttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacat

SEQ ID NO: 1797 - DNA, 4600 bp, Homo sapiens
aatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttcttttttttttctttttttttttttttttttggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaaccctaaatcttgacttttgtcgttattatgcccaatgcctaagattggaaaggccctacagtatctggacactacacaatctgccttagc

SEQ ID NO: 1798 - DNA, 1635 bp, Homo sapiens
cccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcaccttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggatcgctctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcagggtgatcgcacaacctgcatctttagtgctttcttgtcagtggcgttgggagggggagaaaaggaaaagaaaaaaaaagaagaagaagaagaaaagagaagaagaaaaaaacgaaaacagtcaaccaaccccatcgccaactaagcgaggcatgcctgagagacatggctttcagaaaacgggaagcgctcagaacagtatctttgcactccaatcattcacggagatatgaagagcaactgggacctgagtcaatgcgcaaaatgcagcttgtgtgcaaaagcagtgggctcctggcagaagggagcagcacacgcgttatagtaactcccatcacctctaacacgcacagctgaaagttcttgctcgggtcccttcacctccccgccctttcttagagtgcagttcttagccctctagaaacgagttggtgtctttc

SEQ ID NO: 1799 - DNA, 2036 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtccccccccccacctttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaactgtctg

SEQ ID NO: 1800 - DNA, 2842 bp, Homo sapiens
gtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgaccgtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagatgtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaaagaaaatgaactgccc

SEQ ID NO: 1801 - DNA, 4086 bp, Homo sapiens
aaaatagcgggtactgtggtaccggaggctggcggtaccagtgtggattccaagtgatcatcacaggtacatatagtgatcttccttgtccgtctcgtcccactgggtaccaggcgaatcctactgggtaggtcgggtacgcggcatatgtggggtatgtttggtatccaggtatttgaggtacgaattcagtgtacgttgccaggtgtgcttggtcttctaaatttggaatacataggcgaggatactgattctggatagtaaaattgtttggagctcggcaatcataagaaacttgcagtttccaccccctcttcacctggagaacttgggctccattaggtgcaatcgttggagtaattagcccatcttttacatttcttgccacaaaatctcgaagagctgccatttcaggttcggacagtgaatacacatgtccactgggaatactgtgtgctccaggtatcatttctatgtgagggtcaaccaggcggtgatctgggtagacgtgctcatctactggagtgtacacattctggacatagtaatacctcactggttggtaaactctgtatccatctactggataatagagtggcggttgtggtgctggtggtgggagcgatggtggtattggagaatacatccggcagtggtagcggcagtattcagaatcaaagacgatagatcgagtgctccatgtgatattgggatcatgtgtgctcagccagcgaacccctaggacgacagggaagaatggagactgagtcacatcaaatgacagcacctctcggtgatctcccaggtcaactatcaggtcgtgagtttcgtggacaactgggcccgatgctatggggcgcccatcaattgcttccacaagtattggccagtccttgattcttagaggaattccattttgagcaacatattcgtgatcaatgaagttgccagaagcaccagaatcgatcatggctcggacgaacagggtgtgtctgcccggaagatgaatctggagcatcacttgcaagtgtggagatgaggcatcatcttgtggggaccttattatttctggcccggtcgctgaaggtccctctacagcggggccggggagtttcccgccggcgaagactttgaggccttggcaggacaattgtcagcgtagtgacctcctgttccacagtagaggcacaggttcagctttctgcgtctttctttttcttcctgcgtcaggcgcatgcgggcacctcccaccggctcggttggatctacctggtggtggcttgcaatgtgaggcaacaccagcgcccggggtggcgagcgtggcttgcgagctgcagcagccctggccagccttctctcaatgtgaatgcactgcccaatcagagcagacagcgacttggcgacctcgagcaacattaactgaggaaaaaattgaaaaaggggcgcccttgcttgggggcttcctattgtggaactgttatggaaaggagccccatccattgcttcctccttgaatggcaaatgcctttatgatccctataacttgtcccattatgtttagacccttggtggtcagaagggttctatttagggcagtgtcccctgcccctccttgtcctccaaaaattttgggaggcactgacgtggatgtcatggggtcagcacaggcatcaacatccccagagggatggaaccaagcagcctattgcccaggcattcactaacaggcagcccatcctcagcctcatagctggccggggagaagaaaggctattttgggtcccagatctttttttttttttttgagacagagtctcgctctgtcacccaggctgaagtgcaatggtgcggtctcagctcactacaacctccgcctcccgagttcaagagattctcctgcctcagcctcctgagtagctgggactacaggtgcgtaccaccaagcctggctaatttttgtgcttttagtagggacgtggtttcaccatgttgcccaggttggtctcaaactcctgggctcatgcagtccgcctacctcagcctcccaaagtgctgggattacaggcatgagccactgcacccggtctctgtttacaaatttatcaccagcttcatcccctaaggttataagctccatgagggtgggaagtctgtattgttcacctctgtatcctaagcatctagaacatagcccggcacacagtaggtgctgaagaattgaatctgttaatgtagaaaggatgtttcatctagctgaagtgtcttgtacagaataaactctcaataaatgaactgtggacacatggaagggtgagctagagctctgctcaggggttgagtgctcctcttgtgcccttgtggttgtctggttacctgaactaattggagtgcgatgcagacatagtcatggagtgagacagcagaactttgctgtcttgtttgtgagcccacatcaggggttctagactggctggttgacatggtggccccagcctgtctcttcagcagctcggcttataaaaaataaccacctcctattttggcctctttggccgaattcggccaaagaggcctagcctccgattactaaaccccttgccccacaaacgtccacattgacgagcctctttttagtaactgcttccccgtaattccttcagaggttgctgtacccttcgctgatgtgctgccctcctgtaaaacctccagatgccttcccacgtaatgcccctttcagatgctttaagctgagagcttaaaccacaggtaccatggctgacgcctgccaggtttctgctgcagataatctatgatgggaggggcatattttttacttcattacttatgtaaactcttgttccagaaagctttaatgtgtgtgggagtgttctgggtctattaggtctgtgcgcatgggtgtgggcatttgcctgtgtccaccgggtgggtctcattatgaaatgtatgtttatgtagggctttaatggctgaaaatggcaaagagatgaatagaccacttggccccatgtgtaattgccaggccccttctgtgctcaaatgaggtgtccgagtgaaggtcagcccttcccttctgtatttggggcctatttatgccaccagtaattttataagaaatctgaatagttctcccctttgagtgcatttaactctttagtatcttctctcttacctatttgagcccctctagctacagtctggcttaaatgaaaggggaattatatgcttaagaaaaagtaggacacggttgaggcagtttgctgactgaatacgcgaagaaggacctgatgggctcatatgcaccactgccatcacagtccccatcgtgatgcaagcttatatgattcttgaggtaactctaccagatacttccagatttagaaatgtgtcaaaggaaaaattggtgatactcttctttccctgccagaaacagcccagatctcctcttaagcggaaaagagattgaccttctagcagaggcaaaggtaaactcctgtaagttacttctgttaccaaagggaggggggcggcttttgtgaatgtatgaggagcttttgccagagagatattcggaggaggggtgtgcccatatgcacacatatattttcccgcataaccgtatccaatgctagcatttagaggaaggcatttagccaccaaaagtccatccatctatgctgcttccacagagaaaacattttctctttcctcctcttgaacttacataatatcctcctcccattccaaccttagaatggagtcttctgggggcagctgcaaagcgttctccctaggacagatggagcctccctttcctcatctactctgtgggtggtttcagggcccacgagtcaacatgaggagttgtgctggtggtatgtgtgttggaggctgggctggctgattcacagtgacgaggatgtcaataataacaagaatgagaatgatggtacctaataaagactttttttcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1802 - DNA, 2512 bp, Homo sapiens
gcggggcctctaccggcccgatggagcgcgcgggcgctactagccgcgggggccaagcccctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagactattgctctcttcatttatttggcaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaggttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatcctgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaaggtggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagc

SEQ ID NO: 1803 - DNA, 1014 bp, Homo sapiens
gcagaaatagcctagggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtgtgcagagaattcaccgagcgtgagcaaggagaagtccgcttctctgccgtggctctctgcaaggcagcctaatgctctgtgggagggactttgctgatttcccctcttcccttcaacatgaaaatatataccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggttatgttgtcctaaagaataaattttgctgatagtagc

SEQ ID NO: 1804 - DNA, 17569 bp, Homo sapiens
ggatcccttgtaaccccatgatgcatgtttatcttcgtactttttatttttgttgttgtttttttcagatggagtttaagcccagctggagtgcgatggtgcaatcccaactcactgcaacctctgcctcccaggttcaagctatttttcctggcttagcctccggagtagctggaattacagatgtgcgcccccatgaccagctaattttttctatttttagtagaaatagggtttcaccatgttagccaggctggtctcgaactcctgacctcaggtgatccgcctgcctcggctcccaaaatctcttgttatttaaagattatctctttgtctggcttttagagttggatgataacacatataggtctgagtctctttgactttatgctatatgcagttctttaagttacttgaatttgtagatttttgtctttaaccaatttgaaaaatttgaatgattttattctccaaataatttctctactaccatgggtttgcacttccccttctgggaatccaatactatcatactggttggcttgaggtgtcccataagtcccttaggacctgttcacatttctttattcttgcttcatgtccttagactcaggaatttcaagtgtgctatccctatgtgtattgattatatcttcatcctgctcaaatttgctattgaaacactctctggtgagttttcattcaggtatatttttagctccaattgttcctttcttttataatttggtaattaatacctatattgtgatttctattttcagatttctgtagttcttaatccatattttcattagcaattttagcatatttaagacagctgtttaaatgcttctctactaatgcctgtgattcttcaggaatgattctacgatatttatttctcctcataatggactgtgaatttctgttcttggtaatgcccttgtcatttatttttgagctgagtcttgctctgtcaccagaatggagtgcaagtggtgccatctcggctcactgcaacctctgcctcctggggtcaagcgattcctctgctttagcctaccgagtagctgggactacaggtgctcaccaccacgtccatctattttttttttggattttagtagagacggggtttcaccatgttggccaggatggtctccatctcctaacctcgtgatctgctcaccttggcctctgggaagtgcgtgggattacaggtgtgaaccaccgtgcctcggcctgtgtatgccttgttattttatttaactgggcatttgaaaaaataaacatcttttttactgtatatagatttgttctatgtcatgacagtcattaacttatatgtgcgcgagttctcatcaagacatcagccctacgtaaaactcaagtccttctagttgtttctgaacatgtacctatgtggactgtgttgccctttatatttccccaaataaccaatggcttttgaattgcttactattatgaaattttgcatcccagttctcctcaatagcttagatggactattgcatgtctctcccctggcctttgcctataacatctgtatgtgtatagtcaccctgaatctctactgagccactccagaaataaataagtttatttcagtcaattttaggtattttctgatgtttccatgagttatatgggaatcttagaatccaccatcttgttgaaattactctgtgaaaaaaattttcaatatctttataatattacatttatgtcaatgataacaatttacctatttttcaatttctgtttgttttatgaaaaaggaaatagaagcaatcagggcactgcaagttgtgcctactccaagatgtgaatcatggatcatgcaaattacaatcatgttttaacctgacctccaaagggagaataaagtaaaaattatcccatgtgaggattattcaccagtttatatgtcattagttaccagttttcctttatgaataatgtttagcaatattataaagtatatctaatagttatcaggttttttggctcgttactttttggtagtaacttataaaactgactggaaaagaccaataaggcactgtttgcatgttacaaattatatccaaagaccaaaagctgttaataagaaatcttccaataaaaccacatcatattttcttttttatttacacccacatcaggattacaactttatcaggactgcaccttgatcaggaaggcctgtttctcttacaaggctaataagaaaggaacaataaatttgctgatgaaaaaaagtcatgtatttaaaaattttaactttaatttttaattgagggcaatattttaaagaaatgctcattagtcattcctttaaattgtgtgtgtgagagagagaaaatgaaatagtcattcaatgctgcagatgcagaggactcatcatcatggcacaacaaaagagctgtgcactagagttctatatctatgtaagtcacaatttgttctacaaatctctttgagtaatttatgtctcatatatagagatctggaatagcaaaaatacttcagaggaaattaatgagtgtatcatgaccacataataatttacttatgaattttcttaggtaagaaacggttgaactggatgcaatttttatcacagcttgtgtaagactgcctctgtccctcctctcacatgccattggttaaccagcagacagtgtgctcaggggcgttgcagctcattgctcttatagcctgtgagggcacggaagaaacatttgctaaccaggccagtgacagaaatggattcgaaataccagtgtgtgaagctgaatgatggtcacttcatgcctgtcctgggatttggcacctatgcgcctgcagaggtaacaattaatattttagtgttgagagttcaaaggagctagagtaagtggaagctgaccaggttgtcaggcttgtgttccatgttactctgcatgactccctttaaacgtcagtctttgtctgcaatgccgtcttgtcacagggtcatctactgctattgtgcactgtttgtcttctgtatgttatttcacagcttgtcagagtctataaaactcagcagaaagaacacggcttgcctgctccctctcttgaagattgattgtaatgggagtggtttctctgtttctttgtatagtcgaacagatatttacgtcttccaagaagatacaattcagaggaatttttatggcaaaagttagtggagacaggtggatgaaatctgtgaggagagtatcactgttctgatgggcggccgtttgagccacccacactgtaatactagacctgcctaaagagaattttcccatgtactattctcacctctgggaaaattaccctgaatataaatatgtccctcattttaagaaaaaaaaaactagaaccaaacaaggaaagtttaaattctttgtctttgttaatatggggtcagatttgtataaaatattgtaacagaaaaatttcttgttctctgacaagaaaattaatggaatatattttattttctagatttagaaatagctaaatactatttctatcactggaagaaaacttgtatctcaagactgtcttgggaatacaatgtgtgtgaataggaactagttatataaaatttgagtctcacatttctcatctataagatataaggagttacaaagggacattttgaagaccattgacaggagtggtttattttgtaatataaattggcatggagaggaagtaaagatgaggataccactgaagctccggccttggtaagcctttgattgcttgcacagcgaagagaagatcaaagatggtatgaggagagggctgtgagacccggtatctagttccttgtaatttcacaggggggagcctctggaatactttcaaggtgggaagatagtttgctttgtttctgtttttgtcatttaaaagatatactgtcaaatctgtatccaaatttgttacataagtcaatcaattgtaaattttactgcaatcatatgtttcctgacagagttgccttgaatttatggagctgaacccattttgctaattcacttactcctgcagcctatttcttagatacacaaatcaatatccttagagtatacatctttacacctagtatgtggttgtgttatgcagacagaatggccaaaacctgggtagaaaagatctaacataatagactgctatccatagatgtgcctatttccaatataaacctgctggcatctgagaaagtggagttctccctgtttcctaactgataagaatggtggctctagctaactgtttgtgtaaactgtggggtttctgtgcacctgctttgcttttggagactggaagatttgtgtctgctaggcagagtgagtcaatgtatccagtcccagacaaaatcttagcaatggagtatgtagagggcatctcttgtagacaacagttcacatacattgacaaaatatgatgctggataaagtcagtgcgctctgtgcaacatggtgggagaggaatcacaggagcttacactgcattccttcataattccttccatgtggctatttccttgtgttaatttcaccatactaaaaataattaagattatgtctgttaactatagttgcgtcctgttgatttttccaaaaaatcactgaaagtgaaattattttggggacacttccaagctagtggtcaagcagtgatttttctgggactgcagaagttcctgctatgcccaacctttattactaaatgggaaagacccagtcagactgggatgggcttatgattctacatacagagctcatccaagaaaggaggaaaagctgatttttgtgaacgttgctgcttgtgcccgaactaactctcaggcacattagtcagaaaatattacgtttggttgctccccgaggttcctaaaagtaaagctctagaggccgtcaaattggcaatagaagccgggtaccaccatattgattctgcacatgtttacaataatgaggagcaggttggactggccatccgaagcaagattgcagatggcagtgtgaagagagaagacatattctacacttcaaaggtactgtgcctatgagcttgtgtgcacatgtatttattccddgtgattgtgtggaggtggcagttctatgactggatcagggtgaattgtgcttatttattacgatttattcacacttactcatgtattaaaactaatatcaaaggcaggaagtgaagatggctttctcatctttgcagtgttccaattcatgccttcaaagatgcctttactctttgagctcagcacagatcaatatggtttaacatagactatagaatgagagataatcttaatcatattatgttatctgttacctcctgggtgagtttcttacatttgttatgattttgagtttccattgtcattttgatcagagagagagagaagcgatataagagagctcagtgagtataaaagagtgatacctacattgttttaaattgcatccagcccaagttaacatattaaaaactgtgtttgcctcctcagtttccaaaccacaaagatacttagtcttgcccattgggctgaatagatgaaataattacacactaatatgagttgtaaaacttaccaaagataattcagataatgggtatgcttatgatttgataagaacttttaccttccgagtaatttcactctttcattgcaatatatgtactgaactatatatccaacatattataaagttcgtcatgatatggcagaaaaaaaggcatgacaagaagagagagaataattttgcctgtggtcattagttttgaagtagtagaaaatgtctaaatattaggtggagcaaactagtaaaattggctcaagttttgattccacaacttcctttctctaacactctgcagctttggagcaattcccatcgaccagagttggtccgaccagccttggaaaggtcactgaaaaatcttcaattggactatgctgacctctatcttattcattttccagtgtctgtaaaggtaggcagcttgtgtgatcaaattaatttcacttttgttctcagcataaatattgttttcatggagatttgaactaagctttttcttaggaggacatagggattttaacatggaagaagagccctaaacataactcctaattcctttctatggaacagaaagcaattttgaatccatacttccgtgattcgatgtctacaagaaaagagagtcgagaatcctcaaaagcctctgcctaaaaaacttgaggaaatgacaatcgatctccttgaaggctactaaggtcttatgaatgattcctgatgcacctcttgggatgttcacagacacagagtttcatgaagctgtggagtccagaaaacctgctgcacatagggtgcacaatgagtttccatttcttgcctcttttcaaggggcaagaactcagtccgggaatgtcttaaactacaaaccttcatgggaaaccttgttgcttctgcttcctctcttttcacactggaggtttgattttttcttagccatgtaattcccddgatatatgtactaactatatatcgaacatatgataaagttgatcatgatatggcagaacaaaaggcatcacaagaagagagagaataatttggcctgtggtcattagttcggaagtagtaaatgtctaaatattaggtggagcaaactagtaccddaaactggctgaagttgggattggccactggttgctctaacctctgcagctttggagcaattcccatcgaccagagttggtccgaccagccttggaaaggtcactgaaaaatcttcaattggactatgctgacctctatcttattcattttccagtgtctgtaaaggtaggcagcttgtgtgatcaaattaatttcacttttgttctcagcataaatattgttttcatggagatttgaactaagctttttcttaggaggacatagggattttaacatggaagaagagccctaaacataactcctaattcctttctatggaacagaaagcaattttgaatccatacttccgtgattgcatgtctacaagaaaagagagtgcagaatcctcaaagcctctgcctcaaaaacttgaggaaatgacaatcatctccttgaaggcacaaggtcttatttatgattcctgatttcacctcttgggatgttcacagacacagagtttcatgaagctgtggtgtcagaaaacctgctgcacatagggtgcacaatgagtttccatcttcttgcctcttttcaagggggcaagaactcagtccgggaatgtcttaaactacaaaccttcatgggaaaccttgttgcttctgcttcctctcttttcacactggacggtttcatttttgcttagccatgaattcttgtgtcattcataacttttgtcttaaggaactgaaaactagtcaggctagttaatgcaaaagggtatattagatatgactaatgggaaatcaaagccagggtacattaagaatttgataaaaactctaaaaatatatcctttctccacccttatctctgctttattacaaaaggctttttaaatatttgttccaacctttttcgttggtggcatttatggctttggagttcactgtcaggcccatgttcattaccgtgagctcctgtgcatctcctaatttccaaactagcctggaaaacgcctccattgaccatgattggttcatggtcctgtgcacggaacatcacatgttcagggagataaagaactctgatagtggcacctgggtaaaaagtacaatccattatatctggatatcaagatcttttgcagttgaagagaggtattgccacagagaaaattataggagcagaagaaagtcaatgaaagtcaatgatgacactccattaggaaccagaaagatggtatttatttacacatataataggtgtaagagattagaggaagcctgtcacctgaagacattccttataccttcatatgtagtacactttgtacataccactctctggagcgctgcatcacctacctcatggaggattagtgtccttaaatgtacctcagagcatggctatgtgtggagaaattgacttgtgacatcactaaactgactgcttctacttcagccaggtgaggaagtgatcccaaaagatgaaaatggaaaaatactatttgacacagtggatctctgtgccacatgggaggtgagtgtttggaggtgagagaacggataagaaagatgaggtaggatacatctgtttcctatcttcttagtacaagtatggaaaatgcaccattggatcaaaaacttaggaactttacaaaggtagtttttgtgagcagcgaggaaaaagaaatgacaggcatacaaaagagagaagtggtggagaagaattgggggtaaggaggactgggatttctttccttgcctgtacattaatctctccactttcctaaggaggaaacagaaattctcactcttgcaatcactatcttcttccccaatttttctgttttattttctcccttttaagaaccacggctagctagtttgattgtcacatctagacagttgttgctttcacagttctatgttacatttatcttgctcttcagtcgactacacaaatgatacctcacaattcctttttccaggccatggagaagtgtaaagatgcaggattggccaagtccatcggggtgtccaacttcaaccacaggctgctggagatgatcctcaacgagccagggctcaagtacgagcctgtctgcaaccaggtgaggcgccctcagcctcctctgcctttctgttcttcatgcccctgctttctgtcctattggccaagtatccattcatttagacccacttatctttgtaaaagagaagattctagagaacaaagcctcttcctagaagggcatggagtcctcttacttgtaccctgcttagaaaagtcttacgaaaaggtgttgtaactttgatgctgaattgtgtgttacatttataggaggtcaattcgatcaagaagtccaaggattgccaattagactcagggaaaggtggattacccctaagctatgaaagatgaccagagagtggacgggctgaaggtgatttggagggaactgtgcatagatatgaagccatgaagagatgaaatgaacagtacataaggagagagtgagagcaagagaagagaaatactagggattcacatgggcttcggatgtctcagtgcctcttggtgtctctgctttcacacttcttgaccaagggcatagatacactaaaaattatctgcagacagtgaaggtcatccatggtagaaagagaaaatgacctgtttatggagatatctgttcacagtggatgaaatccacactgaggaaggttcagcagaacatggagctgacctatgactgcgggctcctagtcggctgctttttggagtctgtcatgcaatcagctgcttaaacacatctattctatgcatggttctctcatagcctagagataattccatcttttccttgagtcctgactggtgattccaggcctccttgatcaaattgactgcccccaaatgttacacacatttcagcattaaaatcactacacctttcccagtaacttacattttttgttataattttgttataatttggtataatgatatggtctgtgataatttaataaaagcattgagaaattaatgtggtttaatactagtagttccccaatttttaatatggccattttcacactttccaaaaatttgataaaaataatactggagacccatgttaccatttatattcaaaattactaacattttgcaatgttatatggagtatatctgcataaatacatataatgtttctagaacctcttcaaggtaaattgtaaagatgacaattgacccctagagacctctcaaagcatgtcacaggaatgaagatattctcccagttccagtgtcattactgtatctaagaacatcatttatagtgcccttatgtcatttggtatccggtccatattttaatttttcattgcttaatcaaaatatcttttgtagctcttctttttttaaccagaattcaattgtttttatattgttgtatttgatatatcagttaacttgtttttcccagttgaaggttcctgtaaattaaaagttagatgtgagtattttattacattggcttaaaactttggggcaagaaaatgtttttatcatgctgtgtttttcaaattgcacgacactagactgcatacaatcacagaatgccccactagtggtgaaggtagttttaaaaacttggttaagctaacagtggtcagatctgttgtttttaactcatgttttctctttaacaattactagtaatctgctgggggataattctcaacagaagaagtcatattcccatgacaaattttcacatatgattgagtatacatcagtgatttgaacttttttctactgcatttctgttttcttctttgttatttcttatttgttatttccttggggtttttacataatcatttacaattttaaccacttgtttaactattcttacctgacatttaattaaaaataatttctcaccaagtaaaaataataaactactattcctctaagtgagagtaaaggtaaaccttcttgccttcaattagcaatgtactgtgaacgaattactgtaatgaccaccatcagagtagacaaagattgttgttctttttctcattgtcgcactaattgctacagactcacggattcttgtgtatgatttttaatttattttactcattttttaatgctcacatctactcagcatatatatatatattatatatatataatatatatgaagaagatgtggatcaaagactcatgagggcaagtgtaaaagacaaaagcacttgtttcatagggaacccactggtgacatttgagatatcaacatacaaaatccatcatacaaaaaggaaaagtaatgaaagactgtgaaaattatcagtatttatgtgtatatgtatattttctagttcatctatatagatatatatcatagatggcatatatgatatatatatgtcagatcaattagaaaacatacatatatatgtatgcatttttggtattaattaggaaactagttcttttgtttttcagacctgccctcatgagtctttgaccaaattcttgatttctggcacgatttgatgcccaaggctcaaagaatcttacctcatcccagctctgaaattggccgtgtctccttctagtggtcggagttattgagaaaccagataggttcatgagttgcttgtgctcagaaatagcatttctattttcttaggagagagggggcataaaatttatttttatgaaaaagatcatttttgaccaataatattctcagttcaaatttaatgctctacattattcagcttcttttactttggtgattttaatattaatgtaacttttggattatctgatgcttttccatcttgctcgtctgcaggtggaatgtcatccttacttcaaccagagaaaactgctggatttctgcaagtcaaaagacattgttctggttgcctatagtgctctgggatcccatcgagaagaaccatggtaataagagatacaggaagtttgccgaaaacactggtatgataaaaaagctgggagaaaaagggatcatgctgtttcctggagttcactcacagctgacttggggtgagggaagaatttgcatttctgacgagatcccaggtgatgttgaggctgctgtttgggggcctcgcttgagaagctccggtgcagagtggacgccttagtctgttagggagccgcctaacaaactgtatccccagcctcagggcctcagcctttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgaggagcggggctgtgggcctcaggtctcctgcacagtgtccttcacacgtgtgcttcttgtaaggctctcaggacagccttgggccagctccatttccctgtatttcctatgcatgaactctttgtgtacgtcataagggtttcttctactctagcacaggagaggcaacagaggtggagagtaataggatgggatcagaactacagatttgggttagcgttaagtcagtgatatccatatccctctgctggggccatgtccttttctttattttttataatgaagcattgattagatgttctttagtctccaactcatggcggatttttcttcttgtatgtttatgtagtataaattccttatatttattctcttagaattttatctttgcgaagtgcttgtttaactctgcctttttttttggcgaggtggttgtgtgtctttatttttatgtgtaggagaccatatttataccaataccttaggatataagacaaacccacttaatatagaggcttaatgcacaagcatttattgagctcaaggttccatggttagaaaattagcctgggctcagcctaaactcagtccattccttctattcctggctgggctctcatgtgtgttctgggcagtgaaggagctctgcttcaggatgtccctggggcatttgtgtgagtgcccccctctcccatgcagttctttatcctccagccatccagcccagggttcacctcagcacagggcatagtgaatggacatgtgcaaagcctttttaggtctaggctcagagacaccaaccattgcttctgggaaattctatcacctaatgcaagttacaggacaggtagactaaggggtggggaaacacacaccacctcttactggaaggaactgaaattcgatatagccaagcaagtggacacagggacatatgactgttagagggcatgttcctaattgaatcgtatcgattcatatgatatgtgtgaaataatatatcaatagttatatgtatgaatatgaatatatataaattgatatattatttcatatattctcaagaattcatacaagtctctaaagaattaacatccagaatacatacatatgtgtatgttttctaattaggtagatacataaaatatacatcatgtatgatatatattataaaacctatgtcatatatatgacatatatcatgtatatgtatatacgtcactatttgctaaaacattaagtaaaataagtgaagaaatcgataggatactctgaaatagtgatacagagaacgagagaataaaaaatgacaataatgaaacaattgatgaatcgaggtaatggcattccttaaattatttttaaaatatttttggacattagagaattccaaaaaaaaaatgaaaagttatgaaagaatgtggaaattataagtattaatacatatgtgtatgtctctaatcgatctagtatatataagatatatatgatatatgacatatgtgtatataatatatatgtagatactagaaccatacatatatatgtattatctgatataatcttagagacttgaatgtatcttgaaataacatctcccaaatttatctgcgttgtcatattctctgtggttatgtttttcacaaacaaaagtttctatccttcatgtagactaatttttcatgcctctttcttgtggttggtgtgtgttgtgtcttatcctatattgggaatatcacaatattttactgtgttatcttacaaaattgttaatattctttccttataaatttggttaattctaatgggtatgacttttaaaatattatgtgaaataaggatccaaatatgcgtatctaatttttgaatttttagcaaaatttaccatttattgaaaagtttatatttgctcacataacttgaatttttttacctgacacatatatgaaatgtccatgagcaattatctggcctctcttccatcttcagttaacttattcacttttctgtgctataatgttaaaaagtaagtttcacttcatatggacaatattttctacttcttcatttatttaataatatcttagttattcttgactaatgtgttatttaaaattttgaatcatcttattaacttccacaggcaagtaaatgttttagtctctcattgatcattgtaataagcctgcagatcaatgcagagagaactgaatctttgataatattgagatttccagtccatcgatcataatatgaatatcccactacttattaataaatcatctcttaataaatatatcattaattgcataaatttctccacgactgatcattttttttttgagacagagtctcgttctgtcacccagggtggagtgcagtggcacgaactcggctcactgcaacctccacctcccgggttcaagcagttctcctgcctcagcctccagagtagctgggactgctggcgcatgctgccatgcccagctaattttttgtattttagtagagacggggtttcactgtgttgcccaggctgttgcccaggctgttctctaactccgtaaatcaggcaatcctcctgcgctggcctcccaaagtgctaggattataggcgtgagccaacgtgcccggcaattactgataattttaatagtttttgacaacttttcattttcattttgtggattttctaatatatagaaatattaaaagaataatgcaacaaatcttctacctacattcatcaagtgttacattgctgtcatttttttactctctatctctcattttctgtattactccttcagtttccctatggatttatacacttatttgattgaatgtattagtttgagtgacatctttttgatatttagagtctcccaaatttacatagtgagtacccacaccttttgaatgtgaaatcgttagtatttagacaattattggcttgagtgatgttgaaaactgatttttcctattatacctgttcattggagagatagatattcaatgttattcatcaaacctactaaattatgctagacattacaaaattgcctctagattcttgtggggtcttctaggtacatggccctatcatgtgggcacaaagtaagctctgtttcttcttcagcttcctctgagatattctcttcatctgcagtgttgtgcagtttcaaaatattttatctgggaatggatttctgcttatttttgactggttttcattgaccacttgggtgtttagagaggtctttcataaattttggaaacgtatcaatcttttttaagtattgtctctgcaccctattgtctgatgaacttggttgttcccaattggcaatgatgtaatctaaaaataattaaagttccctattactgtgataggtgtttgaattccagttgacttcagaggagatgaaagccatagatggcctaaacagaaatgtgcgatatttgacccttgatatgtaagtgattttggagatggttgttctaatttatttcagaggaggaacgtaggatgggtgttgagagtgtgacctccacaccaggggcacagaggccaacgtagaacagaggtgagaacaggagctttctggaagtctcctcctggattcactccagagctctgttctctggcagggagagtggcctggggtcagcatgggtcaacctgtgcctctgctctcgtgactccaaggaactttccagagcagccaagatcattgctgaatccgcaccttccatgcaggcctgccgtttgtattactgtctagtgtacacactgtggatatggccatgtggtcgcattagatgtttccaaatctgcgcttctatcttgttcttcccaacctgctcaatgtcttaccagatgggaggcagttccgtcaatcttgtgggccaggttccaattccacctctttcacatggatgcttgctggatcctgtcaatttagcattttgaatcatttcaaaccttttacgagcctttctttgcatgttttcccatgagccaaatactgcatttgcctccagaaagtctgtcttagtggagcgaataggagcacttggccttggtgttctgcaatatggagatctcagtgtagagaatgagaagtgttaaaatcaaatgcagagtgtagatgcaaaagcaccattattggagataatttataaccagtaacgagacgttttactattcctctatattctaaggtttctaggattcatacgaaggatcattcatataatgagggaaaaaggaggtaaggtactgactgcagtaagaatttcaccaggtatataggggatgatggggattatgtgtgaaaaaaaacaagcacatggtacatcatagtacccaaaatttggtggatattattagtagtattttatccgcttagcagaaaatacaaaatgaaaaatggaaatgataataagaaaaggaaaagtggcaagcattagaaatgtttacttctgattaatgttttttatgatcatgaaatcaatcactagtgttattgggtagaactcaaatatggtctggagtaaaccacttgcgagctccaagtgtttgctctcggtgtaatcacaaaggataggctcaattccggtaattaacaagttataactgtatatgtgagcagtcatttatctgtgtctttacattttggattatgtctacctataaaatggtttatgcattgtagctctctaatattgggccctatacataaacaataatttaacgtgtctaatctaaccaagtgtgttgcgtatgataggcaggtagtaagtaatatgtaaagtaataaaataaagaacaattactaccagtataattaatgtactcaaaattgtttattagtgatgagcatatatcttccttattcctcttcaatgtaaggcagaaggagttcctgttggaagtgagaatgtgaaatagaaaaggtcagaatgtctctccattgacagatgtgggatctgttgttgagagatgtagagaaatatggtttgacatttcaccttgtgtgttttatgtggttaagttccaggcaggggaatagaattaaattattctttattttgaaaatcaagatatgataaagtcacgagttcattaaacaaagaaacacagattctagagcagtcagaaaatgaacttcttaacatctacactagcggcagcttcctagaaatcactgcgctaccggctagtaacggagtcattgccattcagagtgtgcatttttttttcctctttccagttttgctggcccccctaattatccgatttctgatgaatattaacatggagggcattgcatgaggtctgccagaaggccctgcgtgtggatggtgacacagaggatggctctatgctggtgactggacacatggcc

SEQ ID NO: 1805 - DNA, 791 bp, Homo sapiens
ctctggctggacgccgccgccgccgctgccaccgcctctgatccaagccacctcccgccagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttcccc

SEQ ID NO: 1806 - protein, 255 aa, Homo sapiens
MVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLELEVSHEETEHSYHVEETVSQDCNQDMEEMMSEQENPDSSEPVVEDERLHHDTDDVTYQVYEEQAVYEPLENEGIEITEVTVPPEDNPVEDSQVIVEEVSIFPVEEQQEVPPDT

SEQ ID NO: 1807 - protein, 226 aa, Homo sapiens
MPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAITHSVSTSNVIGFTKHVYVQRLNSTGGRSQYSWFQSVRHSAFRASFSEILEGNTDFSNFKKVLSKSSLTFVKN

SEQ ID NO: 1808 - protein, 52 aa, Homo sapiens [sequence omitted]

SEQ ID NO: 1809 - protein, 592 aa, Homo sapiens
MASEIHMTGPMCLIENTNGRLMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSLDLEADGQPLTPDEYLTYSLKLKKGTSQKDETFNLPRLCIRKFFPKKKCFVFDRPVHRRKLAQLEKLQDEELDPEFVQQVADFCSYIFSNSKTKTLSGGIQVNGPRLESLVLTYVNAISSGDLPCMENAVLALAQIENSAAVQKAIAHYEQQMGQKVQLPTESLQELLDLHRDSEREAIEVFIRSSFKDVDHLFQKELAAQLEKKRDDFCKQNQEASSDRCSGLLQVIFSPLEEEVKAGIYSKPGGYRLFVQKLQDLKKKYYEEPRKGIQAEEILQTYLKSKESMTDAILQTDQTLTEKEKEIEVERVKAESAQASAKMLQEMQRKNEQMMEQKERSYQEHLKQLTEKMENDRVQLLKEQERTLALKLQEQEQLLKEGFQKESRIMKNEIQDLQTKMRRRKACTIS

SEQ ID NO: 1810 - protein, 57 aa, Homo sapiens [sequence omitted]

SEQ ID NO: 1811 - protein, 148 aa, Homo sapiens
MRGSELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKVGRLSAPGSQREGRNPQLNQQ

SEQ ID NO: 1812 - protein, 474 aa, Homo sapiens
MVQQTNNAENTEALLAGESSDSGAGLELGIASSPTPGSTASTGGKADDPSWCKTPSGHIKRPMNAFMVWSQIERRKIMEQSPDMHNAEISKRLGKRWKLLKDSDKIPFIREAERLRLKHMADYPDYKYRPRKKVKSGNANSSSSAAASSKPGEKGDKVGGSGGGGHGGGGGGGSSNAGGGGGGASGGGANSKPAQKKSCGSKVAGGAGGGVSKPHAKLILAGGGGGGKAAAAAAASFAAEQAGAAALLPLGAAADHHSLYKARTPSASASASSAASASAALAAPGKHLAEKKVKRVYLFGGLGTSSSPVGGVGAGADPSDPLGLYEEEGAGCSPDAPSLSGRSSAASSPAAGRSPADHRGYASLRAASPAPSSAPSHASSSASSHSSSSSSSGSSSSDDEFEDDLLDLNPSSNFESMSLGSFSSSSALDRDLDFNFEPGSGSHFEFPDYCTPEVSEMISGDWLESSISNLVFTY

SEQ ID NO: 1813 - protein, 238 aa, Homo sapiens
MESSAKMESGGAGQQPQPQPQQPFLPPAACFFATAAAAAAAAAAAAAQSAQQQQQQQQQQQQQQAPQLRPAADGQPSGGGHKSAPKQVKRQRSSSPELMRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 1814 - protein, 68 aa, Homo sapiens
MVYYPELFVWVSQEPFPNKDMEGRLPKGRLPVPKEVNRKKNDETNAASLTPLGSSELRSPRISYLHFF

SEQ ID NO: 1815 - protein, 572 aa, Homo sapiens
MSYQGKKSIPHITSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 1816 - protein, 325 aa, Homo sapiens
MTERRRDELSEEINNLREKVMKQSEENNNLQSQVQKLTEENTTLREQVEPTPEDEDDDIELRGAAAAAAPPPPIEEECPEDLPEKFDGNPDMLAPFMAQCQIFMEKSTRDFSVDRVRVCFVTSMMTGRAARWASAKLERSHYLMHNYPAFMMEMKHVFEDPQRREVAKRKIRRLRQGMGSVIDYSNAFQMIAQDLDWNEPALIDQYHEGLSDHIQEELSHLEVAKSLSALIGQCIHIERRLARAAAARKPRSPPRALVLPHIASHHQVDPTEPVGGARMRLTQEEKERRRKLNLCLYCGTGGHYADNCPAKASKSSPAGNSPAPL

SEQ ID NO: 1817 - protein, 357 aa, Homo sapiens
MLQIHLPGRHTLFVRAMIDSGASGNFIDHEYVAQNGIPLRIKDWPILVEAIDGRPIASGPVVHETHDLIVDLGDHREVLSFDVTQSPFFPVVLGVRWLSTHDPNITWSTRSIVFDSEYCRYHCRMYSPIPPSLPPPAPQPPLYYPVDGYRVYQPVRYYYVQNVYTPVDEHVYPDHRLVDPHIEMIPGAHSIPSGHVYSLSEPEMAALRDFVARNVKDGLITPTIAPNGAQVLQVKRGWKLQVSYDCRAPNNFTIQNQYPRLSIPNLEDQAHLATYTEFVPQIPGYQTYPTYAAYPTYPVGFAWYPVGRDGQGRSLYVPVMITWNPHWYRQPPVPQYPPPQPPPPPPPPPPPPSYSTL

SEQ ID NO: 1818 - protein, 102 aa, Homo sapiens [sequence omitted]

SEQ ID NO: 1819 - protein, 831 aa, Homo sapiens
MERAGATSRGGQAPGFLLRLHTEGRAEAARVQEQDLRQWGLTGIHLRSYQLEGVNWLAQRFHCQNGCILGDEMGLGKTCQTIALFIYLAGRLNDEGPFLILCPLSVLSNWKEEMQRFAPGLSCVTYAGDKEERACLQQDLKQESRFHVLLTTYEICLKDASFLKSFPWSVLVVDEAHRLKNQSSLLHKTLSEFSVVFSLLLTGTPIQNSLQELYSLLSFVEPDLFSKEEVGDFIQRYQDIEKESESASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKVAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAA

SEQ ID NO: 1820 - protein, 212 aa, Homo sapiens
MLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLKDAAKVCREFTEREQGEVRFSAVALCKAA

SEQ ID NO: 1821 - protein, 323 aa, Homo sapiens [sequence omitted]

SEQ ID NO: 1822 - protein, 141 aa, Homo sapiens
MGFQKFSPFLALSILVLLQAGSLHAAPFRSALESSPADPATLSEDEARLLLAALVQDYVQMKASELEQEQEREGSSLDSPRSKRCGNLSTCMLGTYTQDFNKFHTFPQTAIGVGAPGKKRDMSSDLERDHRPHVSMPQNAN

SEQ ID NO: 1823 - DNA, 6188 bp, Homo sapiens
caacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggcgggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatccagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccaccgccgccgcctccatcttacagtaccctgtaaatacctgtcatgtccttcaggatctctgccctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaaacctccatcaccatctaaattataggctgccaaatttgctgtttaacatttacagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaacttttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgc

SEQ ID NO: 1824 - DNA, 866 bp, Homo sapiens
ggcagagccacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccrgctaaaaaaaaaaaaaaaaa

SEQ ID NO: 1825 - protein, 234 aa, Homo sapiens
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRVPVFNIVILLAGGFLSKSLVFSVLFAVTLRSFVP

SEQ ID NO: 1826 - DNA, 192 bp, Homo sapiens
atgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcga

SEQ ID NO: 1827 - DNA, 288 bp, Homo sapiens
cacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtt

SEQ ID NO: 1828 - DNA, 141 bp, Homo sapiens
cacacacaaacacagaaccacacagccagtcccaggagcccagtaatggagagccccaaaaagaagaaccagcagctgaaagtcgggatcctacacctgggcagcagacagaagaagatcaggatacagctgagatcccag

SEQ ID NO: 1829 - DNA, 111 bp, Homo sapiens
gtgctgggaagggaaatgcgcgacatggaaggtgatctgcaagagctgcatcagtcaaacaccggggataaatctggatttgggttccggcgtcaaggtgaagataatacc

SEQ ID NO: 1830 - protein, 64 aa, Homo sapiens
MRCHAHGPSCLVTAITREEGGPRSGGAQAKLGCCWGYPSPRSTWNPDRRFWTPQTGPGEGRHER

SEQ ID NO: 1831 - protein, 96 aa, Homo sapiens
HTQTQNHTASPRSPVMESPKKKNQQLKVGILHLGSRQKKIRIQLRSQCATWKVICKSCISQTPGINLDLGSGVKVKIIPKEEHCKMPEAGEEQPQV

SEQ ID NO: 1832 - protein, 47 aa, Homo sapiens
HTQTQNHTASPRSPVMESPKKKNQQLKVGILHLGSRQKKIRIQLRSQ

SEQ ID NO: 1833 - protein, 37 aa, Homo sapiens
VLGREMRDMEGDLQELHQSNTGDKSGFGFRRQGEDNT

SEQ ID NO: 1834 - protein, 20 aa, Homo sapiens
MAKGDPKKPKGKTSAYAFFV

SEQ ID NO: 1835 - protein, 20 aa, Homo sapiens
PKGKTSAYAFFVQTCREEHK

SEQ ID NO: 1836 - protein, 20 aa, Homo sapiens
AFFVQTCREEHKKKNPEVPV

SEQ ID NO: 1837 - protein, 20 aa, Homo sapiens
EEHKKKNPEVPVNFAEFSKK

SEQ ID NO: 1838 - protein, 20 aa, Homo sapiens
EVPVNFAEFSKKCSERWKTV

SEQ ID NO: 1839 - protein, 20 aa, Homo sapiens
FSKKCSERWKTVSGKEKSKF

SEQ ID NO: 1840 - protein, 20 aa, Homo sapiens
WKTVSGKEKSKFDEMAKADK

SEQ ID NO: 1841 - protein, 20 aa, Homo sapiens
KSKFDEMAKADKVRYDREMK

SEQ ID NO: 1842 - protein, 20 aa, Homo sapiens
KADKVRYDREMKDYGPAKGG

SEQ ID NO: 1843 - protein, 20 aa, Homo sapiens
REMKDYGPAKGGKKKKDPNA

SEQ ID NO: 1844 - protein, 20 aa, Homo sapiens
AKGGKKKKDPNAPKRPPSGF

SEQ ID NO: 1845 - protein, 20 aa, Homo sapiens
DPNAPKRPPSGFFLFCSEFR

SEQ ID NO: 1846 - protein, 20 aa, Homo sapiens
PSGFFLFCSEFRPKIKSTNP

SEQ ID NO: 1847 - protein, 20 aa, Homo sapiens
SEFRPKIKSTNPGISIGDVA

SEQ ID NO: 1848 - protein, 20 aa, Homo sapiens
STNPGISIGDVAKKLGEMWN

SEQ ID NO: 1849 - protein, 20 aa, Homo sapiens
GDVAKKLGEMWNNLNDSEKQ

SEQ ID NO: 1850 - protein, 20 aa, Homo sapiens
EMWNNLNDSEKQPYITKAAK

SEQ ID NO: 1851 - protein, 20 aa, Homo sapiens
SEKQPYITKAAKLKEKYEKD

SEQ ID NO: 1852 - protein, 20 aa, Homo sapiens
KAAKLKEKYEKDVADYKSKG

SEQ ID NO: 1853 - protein, 20 aa, Homo sapiens
YEKDVADYKSKGKFDGAKGP

SEQ ID NO: 1854 - protein, 20 aa, Homo sapiens
KSKGKFDGAKGPAKVARKKV

SEQ ID NO: 1855 - protein, 20 aa, Homo sapiens
AKGPAKVARKKVEEEDEEEE

SEQ ID NO: 1856 - protein, 20 aa, Homo sapiens
RKKVEEEDEEQEEEEEEEEE

SEQ ID NO: 1857 - DNA, 28 bp, Artificial Sequence
  PCR primer
agtgcgaattcgggctgcgtgcaggagg

SEQ ID NO: 1858 - DNA, 32 bp, Artificial Sequence
  PCR primer
ggactcgagctactgcaagtctggtgtggatg

SEQ ID NO: 1859 - DNA, 33 bp, Artificial Sequence
  PCR primer
agatgaattcacgcgtccgcgccgcgcggcgca

SEQ ID NO: 1860 - DNA, 31 bp, Artificial Sequence
  PCR primer
agttctcgagtcacctccctgggcccctttg

SEQ ID NO: 1861 - DNA, 945 bp, Homo sapiens
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattcacgcgtccgcgccgcgcggcgcaggggaggcgagaggcgccccccggtggagagcctgagccccgcgcaagtctggcggcacctggcgagcggagccggagtcgggctggggaccgcggggttgaggccggaccgcggcggggtcgggggagaaacgcgcgctgccctggcacgggccccaaccccccggccgcgcggaatggtatggcccggccggagttaaggccggggggaggcggcgagtcccgcggcggcggcgacgatggggctgcgtgcaggaggaacgctgggcagggccggcgcgggtcggggggcgcccgaggggcccgggccgagcggcggcgcgcagggcggcagcatccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtga

SEQ ID NO: 1862 - DNA, 822 bp, Homo sapiens
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattcgggctgcgtgcaggaggaacgctgggcagggccggcgcgggtcggggggcgcccgaggggcccgggccgagcggcggcgcgcagggcggcagcatccactcgggccgcatcgccgcggtgcacaacgtgccgctgagcgtgctcatccggccgctgccgtccgtgttggaccccgccaaggtgcagagcctcgtggacacgatccgggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtag

SEQ ID NO: 1863 - protein, 314 aa, Homo sapiens [sequence omitted]

SEQ ID NO: 1864 - protein, 273 aa, Homo sapiens
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFGLRAGGTLGRAGAGRGAPEGPGPSGGAQGGSIHSGRIAAVHNVPLSVLIRPLPSVLDPAKVQSLVDTIREDPDSVPPIDVLWIKGAQGGDYFYSFGGCHRYAAYQQLQRETIPAKLVQSTLSDLRVYLGASTPDLQ

SEQ ID NO: 1865 - DNA, 790 bp, Homo sapiens
ctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcag

SEQ ID NO: 1866 - DNA, 784 bp, Homo sapiens
ccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcag

SEQ ID NO: 1867 - DNA, 789 bp, Homo sapiens
ttccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcag

SEQ ID NO: 1868 - DNA, 785 bp, Homo sapiens
tctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcag

SEQ ID NO: 1869 - protein, 236 aa, Homo sapiens
MESSAKMESGGAGQQPQPQPQQPFLPPAACFFATAAAAAAAAAAAAAQSAQQQQQQQQQQQQAPQLRPAADGQPSGGGHKSAPKQVKRQRSSSPELMRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 1870 - protein, 236 aa, Homo sapiens; identical to SEQ ID NO: 1869

SEQ ID NO: 1871 - protein, 237 aa, Homo sapiens [sequence omitted]

SEQ ID NO: 1872 - protein, 234 aa, Homo sapiens
MESSAKMESGGAGQQPQPQPQQPFLPPAACFFATAAAAAAAAAAAAAQSAQQQQQQQQQQAPQLRPAADGQPSGGGHKSAPKQVKRQRSSSPELMRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 1873 - DNA, 1353 bp, Homo sapiens
gcagcatgtaacctggcctgcatccaggaaatagaggacttcggatccttctaaccctaccacccaactggccccagtacattcattctctcaggaaaaaaaacaaggtccccacagcaaagaaaaggaataggatcaagagatacgtggctgctggcagagcaagcatgaattcgatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcagaatctctctccgtggcagcagaaaatcagccatattcttattgcctgctgtctggcagtttgggcttgaacatcgtcagtgcaatctgctctgcagttggagtcatactcttcatcacagatctaagtattccccacccatatgcctaccccgactattatccttacgcctggggtgtgaaccctggaatggcgatttctggcgtgctgctggtcttctgcctcctggagtttggcatcgcatgcgcatcttcccactttggctgccagttggtctgctgtcaatcaagcaatgtgagtgtcatctatccaaacatctatgcagcaaacccagtgatcaccccagaaccggtgacctcaccaccaagttattccagtgagatccaagcaaataagtaaggctacagattctggaagcatctttcactgggaccaaaagaagtcctcctccctttctgggcttccataacccaggtcgttcctgttctgacagctgaggaaacgtctctcccactgtttgtactctcaccttcattcttcaattcagtctaggaaaccatgctgtttctctatcaagaagaagacagagattttaaacagatgttaaccaagagggactccctagggcacatgcatcagcacatatgtgggcatccagcctctggggccttggcacacacacattcgtgtgctctgctgcatgtgagcttgtgggttaaaggaacaaatatttagacattcaatcttcactctttcaattgtgcattcatttaataaatagatactgagcattcaaaaaaaaaaaaaaaaaaaaaaaaaaaaaaaaaaaaaa

SEQ ID NO: 1874 - protein, 250 aa, Homo sapiens
MNSMTSAVPVANSVLVVAPHNGYPVTPGIMSHVPLYPNSQPQVHLVPGNPPSLVSNVNGQPVQKALKEGKTLGAIQIIIGLAHIGLGSIMATVLVGEYLSISFYGGFPFWGGLWFIISESLSVAAENQPYSYCLLSGSLGLNIVSAICSAVGVILFITDLSIPHPYAYPDYYPYAWGVNPGMAISGVLLVFCLLEFGIACASSHFGCQLVCCQSSNVSVIYPNIYAANPVITPEPVTSPPSYSSEIQANK

SEQ ID NO: 1875 - DNA, 1155 bp, Homo sapiens
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattcatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcagaatctctctccgtggcagcagaaaatcagccatattcttattgcctgctgtctggcagtttgggcttgaacatcgtcagtgcaatctgctctgcagttggagtcatactcttcatcacagatctaagtattccccacccatatgcctaccccgactattatccttacgcctggggtgtgaaccctggaatggcgatttctggcgtgctgctggtcttctgcctcctggagtttggcatcgcatgcgcatcttcccactttggctgccagttggtctgctgtcaatcaagcaatgtgagtgtcatctatccaaacatctatgcagcaaacccagtgatcaccccagaaccggtgacctcaccaccaagttattccagtgagatccaagcaaataagtaa

SEQ ID NO: 1876 - protein, 384 aa, Homo sapiens [sequence omitted]

SEQ ID NO: 1877 - DNA, 861 bp, Homo sapiens
atgcatcaccatcaccatcacacggccgcgtccgataacttccagctgtcccagggtgggcagggattcgccattccgatcgggcaggcgatggcgatcgcgggccagatcaagcttatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcagaatctctctccgtggcagcagaaaatcagccatattcttattgcctgctgtctggcagtttgggcttgaacatcgtcagtgcaatctgctctgcagttggagtcatactcttcatcacagatctaagtattccccacccatatgcctaccccgactattatccttacgcctggggtgtgaaccctggaatggcgatttctggcgtgctgctggtcttctgcctcctggagtttggcatcgcatgcgcatcttcccactttggctgccagttggtctgctgtcaatcaagcaatgtgagtgtcatctatccaaacatctatgcagcaaacccagtgatcaccccagaaccggtgacctcaccaccaagttattccagtgagatccaagcaaataagtaa

SEQ ID NO: 1878 - protein, 286 aa, Homo sapiens
MHHHHHHTAASDNFQLSQGGQGFAIPIGQAMAIAGQIKLMTSAVPVANSVLVVAPHNGYPVTPGIMSHVPLYPNSQPQVHLVPGNPPSLVSNVNGQPVQKALKEGKTLGAIQIIIGLAHIGLGSIMATVLVGEYLSISFYGGFPFWGGLWFIISESLSVAAENQPYSYCLLSGSLGLNIVSAICSAVGVILFITDLSIPHPYAYPDYYPYAWGVNPGMAISGVLLVFCLLEFGIACASSHFGCQLVCCQSSNVSVIYPNIYAANPVITPEPVTSPPSYSSEIQANK

SEQ ID NO: 1879 - DNA, 186 bp, Homo sapiens
atgcatcaccatcaccatcacacggccgcgtccgataacttccagctgtcccagggtgggcagggattcgccattccgatcgggcaggcgatggcgatcgcgggccagatcaagcttctaagtattccccacccatatgcctaccccgactattatccttacgcctggggtgtgaaccctggaatg

SEQ ID NO: 1880 - protein, 62 aa, Homo sapiens
MHHHHHHTAASDNFQLSQGGQGFAIPIGQAMAIAGQIKLLSIPHPYAYPDYYPYAWGVNPGM

SEQ ID NO: 1881 - DNA, 69 bp, Homo sapiens
ctaagtattccccacccatatgcctaccccgactattatccttacgcctggggtgtgaaccctggaatg

SEQ ID NO: 1882 - protein, 23 aa, Homo sapiens
LSIPHPYAYPDYYPYAWGVNPGM

SEQ ID NO: 1883 - DNA, 6799 bp, Homo sapiens
gccacgtaagaagtgtctttcgcctcccgccatgattctgaggcctccccagccatgtgcaactgcgtgtttactgctctgggcccagtgcctccctcgctcaatggagtgacggcatccaactcacaagacaggagactcaacagaatgaccaagtggagaagacgtctaagttctcagcggtctcagccgaatgactgaagaggaaccagggacagggatgactcacatgggaagaggaccccactttgttctgtttgattctaagaggacacagactgcttcattcatttcagtttccccagcacctggcttaactctcagacatgttagacggtttgtaagcaccggctctactgaactggcatcaaatcatgacctggttcagaagagacacgaggactggatctgttctaaacagattgtgcaaaggggaaagacacagactcagcatttccacagcttttaacatttcagcgagaggtgagaaagcatgtcaggaacacaggccccggccgatgaaagtgtctgatgctaacacatgaactgtcttctgctgggcacactaaggggccacaagcaagctacgccccagagccactccacattctctctgggtgcactggccctcggccacgcaaggccgcgccagcctccgaggtgagccagaaggacacacacctgtggactcgatgtccctgacttgggctcgatggccagccccagggtgactccgcccgccagcgctttcttcaggctctccttgacctccgtcagctccagctccaggctgacacgctccgcctccttctgccggcactcctcctccagctgcttcagcttctcctccaggatcgcctgcggcttcctgcctggaattcccagaaacgccgttactcccgcggcaggcacaggttctccaaacaacagagaaggcacctggtccccaagaagaacttccacaaaacgtctgaggtcgagctcccctgacttaggtcctcgttgtgaaacttaaattcagcagttctctaagggatcagagtccttctcctaccatttccctttgctgcagccgttgaggactcggaccaggaaagaggagatgctgattctgacgaaggccaggagctcctggctctgggcctcaatgttctcattttaaaacgtggaccctaaactccacagttcccaaagctgccaccttcttggagtgtgaaccctgtcctcccctaacgctccgccgatccttcagtcatcttatttgcgcccgaggcaatgaacagtagctcagcttgcatctctactggacatggcacacatttctttaaggcacattcacttattttatttgaggtttgctgcagtgacctaagatgcacccactgggcagatgagaacaccaatcccaagaggtgaacggacttgtgcccagggcctgggccggtggtggccggcaggcgaggttctctttttcaaagccaaaagcactcctggccctcctgcatcttcactatcctgcaagctgggaacacgggagaaatgctacttctgtctcattaaactccatgccccgtcccattctctggcacagcctcctcccgtagggtcagcctcagactgcaggccacatcctgggcctcctatagggtcagcccgacctgccctgccaacacctgccttccctcctctaaactccaaaagcatttcccttcatcagatcattgaggcacaaagtccagcaaggctggagctgctaaccacctgctgggtgtgcgtcagctcctccccgcgcggcgagccatgggaaggccacagcctcttctctggaccacccagggctctgaggcatctgaagcccccgtcccagcccaggccagtacaatctcaatctaaggagccagtcttccgtagtctaagcaccgggctggaagggaggccatgcgtaggtaagcggtgccaccccaggctcaggagctgagcgccagctcccgccagcaggaattgcacgcgcctggcccagggctgccactctggctgcaaactcagtttctgtgacttcagtccctctctggtgtctgtattccattagcctggcctcttccctgatgcatcccaagacagatgctgccttgctctcgcctgtcccttctcaacaaacgaggggctgcttctacccttgtctggacttctgaatattactgacccctgtgggctaccctctgtagagaaatccagctgatccctcctacccggtgaccagaatctactgcgtcctgcggatacaggggccatcctccagacaatctctgttgtcagcgccagaagccggaacaggtcccccagcacctcccctgcctcggtgagcagcgtgtgggtctggccctggcctctgcctgcacgccgcatgtttgaccacacaggcacctgcctcggggttaccagcaatgtttccaagccccaagaaacactgtgagataacccactcttactaaataaaatgacagccttggtgagcaataggtcctttgggcaaagcagaatgaaatctccagtctctaatacaaacatgcaccctgggcagtcacccacacccttcataccggcgttcacttcaatagccgctcgaaggtcttttctttccttgcggagctgggccagcctattccgcagggcctctttcctcttcagcagctcctcctctttggtctgtagccgcttggcatctgcttctacccggttcttgccatacttgtactgggcagcatcttgagaagaaaaaaaagcagcaattaaaaattaggtttactagcctgggaaatatgggacgatcccttctccacaaaaaatacaaaattagccaggcatggcggcacatgcctatagtcccagctactcaggaagctgaggtgggagaatcgcttgagcttgggagcttgaggctgcagtgagctgtgatcctgccactgtgctccagcctggatgacagtgagaccccgtgtcaaaaaaaaattaggtttattcaagcagataatggggtaactcaaaaagcctgttgaatcagccaactcagtaaacaaacacaaagcattattttgctaattcaacaagaaaaggacagggctggtatgaaccaagcagaaaagtgactagttcaaattctccaatattctttgaatcaaattcttaaaaacgaaaacagaatattaggaaattcctttaattcacttccctttgaggcacacggcttataattaatctgcaacaaggtggagaatgaacattctataatcggaaaagacaggagtaatatcaaaaataatgtctgaaatttgcttccttctctacgtcttcaaatccttccctaacaccgcagtatctgttccttatggccatgtcatctgactggctctgaattgctgctacacccccagcactgagattagcacccggcacggagtgtggcacaataaatgcttgtttagtgaataaatgaacaacggatacatgaagaggcaaccaggagcggtatctggagcctgactgtctaggaaggagtcccagcttacacttgtagctgcatgacctggaacagggcacgaatccctctgtgcctcagtttccctcatccgtgaaatggggatagtaagagcaggcaattcactgagtggttacgaggattaaatatttataaagcacttagaacaaacacaaatgggcaacacataaatgcttatttcataaaatgaataaatgaagaggaaactagctgtagggaaaatttacagacttggcaacttcacatcaccagtgaaaacagctttcaaaacctgaccccatgctctctcctattatgttggcttttcaataacagtaatttaggacaacacctctttgttaagacacatggaagagatgaaggttctaacaaaactcggatggaggatcaccgatttcaaagcttccgtggtctcccagtcgcttctaacaatcactcacgcctgaaggcaactcccaggccttcctgactgcacaccccaagtgtctgactccctcacaaggctagaaactacttcaggtagaagccacaggggtggcataatgattaagaataaaaacactggactcagagaggtggctagaaacccacactccaccctcccttgctccatgactctgcaagcaacctccggagaagctcagcttcaccctctctaaagcagaacgagaaggaatcctgtgtgtgtgtatgtgtgtgtgcgtgcgtgtgcatgcgtgttttaaattagaacgttatatctgaaaaaaatctaacaaaatgatacgacgcctgatgtagtggacattcactgacaattcttaccatatcagcgataagtgattcccagagccttgtccactcagggacagcagggagccatttctagcacctgtcctaaatgctggatttgccaattcttgcaacgtaagttatcatgatttcaatgaaatactgcatttatgaaggcataaaaagtgatcactccccagtcaattttcccctaatcaaaagaaccacatagaatgacagcaaaagcgtcggcagcctgaggagaggcgaagcattcgacaatctgaaacaaaaggatcgctgtttgcagctaaggttaacaacatatttggcaaacagggccaagtccaaactctactcgcttatttctaaactaagctgtttccccaatgaactcaatgcaatcacctataaatttccacatcttttggtccccatgtaataaatcccatctaatctataatgcaaccggctggattcaagcaaaaacacggaatgccattatttttctcttttgtcaccattagacgtcaccacagttaataaaaactccctacagaacatcccataaaataaaggaataaatcatctaggaaataaagtcagcacaggtactgacagagaaacaccatggcgattgagactccgtgggactccgattttgcttgtaacaaagctttccaggtgtgagctgctcctctcccccatctgcccctcctcaaagaaacaacactaaaagaggtgaaagtaaatacacctgatacattcaggaaataagatttgccagataaggtcaaaggaagttagtacattaaacaaatggtggtaggagggaggatttggcccaactggctccaacctatctggtcaacacgtatgttgggtagaacagaggtggagaaaagcctagatcagggatgtatacgcttccttggggcagacgcagcctggccctgcggagcgatttcaagcctcgttcacgaacatggccaaggacactgccagcctcttcattcccctgtgtggatgctccaactccaaaagtggaaccacagggcaaatgaatgtcggcacgtgtcggtatggcagcctcgctcttcgacagctggtgtgggggttaccacctggggctagctggcctcatcttcgttagcactgagactggtctaccagttgcacagattcagatttgaaaatctcaggtgcaaatcccaagtggcgatggcatgtaaccacatcaaactcaacatctgcacctaactcccaccttctttctctgggaaatcttcctggacatgcccagatggactcaggagcccatcacctgtaaatccccacactgcagccctgccacttgcttgtctgcatgtgtgggtccgctggaccactttggtgtatctttgagccccttgagtgaaaaaatgctgcctggctggctccctgattagacatccaacataatgaggactaacaccaatacaaacacttaagagatgacatatcgccctagctggatctactacagggaagggaagagggtgctgggtccaggcaggctgagtgtctcatgtcttaatgcttctctgcccaatctatttccggctggatgtggagtctgaaggcctggcacccactctggctctgtgatttaccagctgtgagccttgggggagctgcttactctcttggtgattcttttctcatttctatgatggggtagaggataatgcctatgcttacaaagtggctgtgggaagtaaaccggatgggataagaatggcttgctgtggaccacaggcaccgcaggataaccattcctcagaactcctcatactgctctagtgcttggaggtccgtgtattacctcagctattccaaccgcaccaaccacgggagccacgtgtctacgtctgacagataaagatgctgagtttagagtctgcaaggcttgacaaccacagatcagggacaggagctgaggtctcctgacctggagcccagggccacccggagctgcaagaaacctgcactcacaactgcctcctattttaaaatgctgagtcgatcccacaggtggcaaaccagttctgggcttcaatttacaagcagtcagaaaagctgggttgaaatcgccactgtccttctatgtggctgatgaggaaggatgacggtgcccaccgctccatctctccagctgaccccaagctggcactcacgggtgggcaggctcagacaggcccagctccaccaagtgcacttgaagccggaatgcaagacatccgatggtatacttactcgaacccgtccttttcacaacagccgcgggatccgctttctttggctgactgctcagagtcttcccttttcctgtgaccccattagacgccacggggggctttttacccttgagctgttgaaataaacatataagaacattaaaaataaacacaaagtcaaaaaaaaaaaaaaaaa

SEQ ID NO: 1884 - protein, 91 aa, Homo sapiens [sequence omitted]

SEQ ID NO: 1885 - protein, 56 aa, Homo sapiens
MTWFRRDTRTGSVLNRLCKGERHRLSISTAFNISARGEKACQEHRPRPMKVSDANT

SEQ ID NO: 1886 - protein, 56 aa, Homo sapiens
MLTHELSSAGHTKGPQASYAPEPLHILSGCTGPRPRKAAPASEVSQKDTHLWTRCP

SEQ ID NO: 1887 - protein, 100 aa, Homo sapiens
MASPRVTPPASAFFRLSLTSVSSSSRLTRSASFCRHSSSSCFSFSSRIACGFLPGIPRNAVTPAAGTGSPNNREGTWSPRRTSTKRLRSSSPDLGPRCET

SEQ ID NO: 1888 - protein, 195 aa, Homo sapiens [sequence omitted]

SEQ ID NO: 1889 - protein, 90 aa, Homo sapiens
MTALVSNRSFGQSRMKSPVSNTNMHPGQSPTPFIPAFTSIAARRSFLSLRSWASLFRRASFLFSSSSSLVCSRLASASTRFLPYLYWAAS

SEQ ID NO: 1890 - protein, 104 aa, Homo sapiens [sequence omitted]

SEQ ID NO: 1891 - DNA, 1450 bp, Homo sapiens
gttggtgctcagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatccttcctgccataaaagctatgacacgagaatcagaatattaataaaactttatgtactgctgtagc

SEQ ID NO: 1892 - DNA, 599 bp, Homo sapiens
gggtcgaggtcgacgggtatcgataagttttttttttttttttttttaaaggagcaatgacatttcctagaagttactctaagaatttccctagagggtcgggtatcatctcagccagatctttctcatccttcaaggccctgtttggtacagcttgctaggaagctgttccagactgcagcagccctctctggggtctctctaccacttcccaggcactcagaacttgtgcctcagtagactgttttgtggcactgtcccattctctgattctccatgtgagctggttttatcccatccagcatggctgtgaaatcctaaaggttcaaaccccagccactcttcacctatatttcccccaaatggctagcacgggaaagggcccaaagtaggtgctcagtgctgatgagagagtagaatttaaataccccaggaagcattgtgagttactacggaggccatgaaatgctgccacctccccaagctgattaaagagtgatactaggaaaataggtagggaagggctaatcagaaatgcctctggttcagaagatgctgagttttaaagtccagagagccaaagaaaaaaaaaaaaaaaa

SEQ ID NO: 1893 - DNA, 8372 bp, Homo sapiens
  misc_feature 2677, 5116, 5117, 5121: n = A,T,C or G
aagcttggtgccatctattttggactatgccttgcatacagctttatgggaacatttgtcaggcaaaagtataataatggcaaactctacgccttttattttaaattagattggtgtgatttgatgctgacgggagtgagagtaatggccttatcctgctgcaggctgtgctgaggatggcctggtctgccaccctcctcgagtagcattttgcatgtgtaacagggtctcccctctggggcacaacaacaaagagaagttgctaaggacaagaagcaggtgcggaaatgcatctcccattggaacagccctgggcttactccaatggctgagagaggtgctatggccagtcctcccagagctctgcagctgcacttgggggtggacagtctcgtgcttgtcctgcgtgataacggccgtgaaagccagccaactgctgcccaaaatcacccagccgattgggggtttcccatcggcgcaccctgcccggagccaagaagacaggctggtgctgctgtatttgtatttatatccattgctgcgctctgcgttctcgtggcacgcctggacactcctccgcctccccctcctcttcctcctccagggccacctccccgccttccccacccccatctgcttctgtcaaatgagaaagtcaccgaggagaacccaaacactccagccgctgagagccccctttggcacttggcagcacgcggcggcgggctcctcggctcaacttcgaggagtctccgcgacgcaacttttggggacgctttgcatttaagagagaacgaccgaggaggaggagcgctctgcccggccgccgctacctgcggggagctcaccagcaaacgccactgcagacgaaggacccaaagaacgtaaagggcaaactgccgccgcggggagggggcaccgccgagaagttagagtgtcccagagacaacctgctcgagcgctcggccggagacactaaggcggcccggggcgcggcgtggccctggctggtcccccagccccctcctccggggcgggagcgacgccggggcgcgacgagccccggccggccgagcgggtctccgcgggcagccaacattgatttcctccgggccgagggcgagggcccgggcggcggcgggctgcagccgcggcagggcgagagcatgtccaagccggtggaccacgtcaagcggcccatgaacgccttcatggtgtggtcgcgggctcagcggcgcaagatggcccaggagaaccccaagatgcacaactcggagatcagcaagcgcttgggcgccgagtggaaactgctcacagagtcggagaagcggccgttcatcgacgaggccaagcgtctacgcgccatgcacatgaaggagcaccccgactacaagtaccggccgcggcgcaagcccaagacgctcctcaagaaggacaagttcgccttcccggtgccctacggcctgggcggcgtggcggacgccgagcaccctgcgctcaaggcgggcgccgggctgcacgcgggggcgggcggcggcctggtgcctgagtcgctgctcgccaatcccgagaaggcggccgcggccgccgccgctgccgccgcacgcgtcttcttcccgcagtcggccgctgccgccgccgctgccgccgccgccgccgccgcgggcagcccctactcgctgctcgacctgggctccaaaatggcagagatctcgtcgtcctcgtccggcctcccgtacgcgtcgtcgctgggctacccgaccgcgggcgcgggcgccttccacggcgcggcggcggcggctgcagcggcggccgccgccgccggggggcacacgcactcgcaccccagcccgggcaacccgggctacatgatcccgtgcaactgcagcgcgtggcccagccccgggctgcagccgccgctcgcctacatcctgctgccgggcatgggcaagccccagctggacccctaccccgcggcctacgctgccgcgctatgaccccgcggggccgcctcgcgaggaccggtgtgcacacgtgtacatatgtataggtacgagcgctgcggcctccccgtgcgccctcccgcgaccgggggcccggtttgtatgtacatagaatgtataggtgccaggtagaggcagagaggccaggcggggcaggagtggccaagcgcgcaagggcgcgggcgagcaggcctgtgaattcgcaggatcatttcagacccgcacttcggcagccaactcgaaagcaggcggttgtgtgcggcagcagttggcgtttgctttgcacttcggaacctgttgcgttttgacccacggaggtggaggagtaactttttgacatgttggcctttccagttttgttggaagtttcatggtcggttttgtttttgtttctcattcttcttcctcgcccctcagccccccaacccccaaccccctcccggtccgtgttgcatgcacgctgttcaaatgtgaggtctgaaatggctggcacacgggaaaagctgcttgtgtcattcgtttctgggagtgggatggctctgagcagcctcgcctccctgtttgtactatttgaactttgcagatctctgttctctcaagcagaactcccaaccagatccattcttgaccagtgaccggctcgaatctggccttttgtgtgagatgatcacggnttcttttgtttatcacgccatttgcaaatcagagcaagagctctttctcaagggcaagaaacgcaaacaagaaatatttgtgagatgaaagttgtcaattggattttcttcctaaacaaacaacaacaacaaactactagaagtctccctgagtccactcgcttggatttctgacacagtttacaaaaaaggaaaaaggcactgctcctattttcccttatggctgagttcaccttaagattgtaaatgtgtatatgtcagtgaaaacattgaggcttggaaaatgtgttattttcgttgccctaagtttgagtcgactttagactcaaaaacattttgagcgaatatcaaagttaacttttaaaaattgcgaaactatttcagaatcgcaattttatcgaagattaaatcagacttttttgtctggtaattatatatttattatttagcaaaactgaagaaaaaaagcacagaattgtttcaacagatgtctctcattttcagctagcatttctctcccaagttgagctggtttaatgtgttttggatttccctcctcaattggcttattttttagatcacctgcaattcatttgcaaattgcaataaaacacattttagaaaaaaggaaccttcaattattagctttgtttctttttaaatgtatatattttgactaatgtttgtgaatgaagttggctaacatgtatttagtttcattttggctttatgtaatataaagtttttaaaattttaaatatggttttaacctttatgtgtaaatgattttctagtgtgaccttctaatttaatattagacgtctaaggtatatctgtaaattagaatccgactatcactctgttcattttttttgaacaaagagtttaaataaagcctgaaccagggaaaagaaaaatcttctatttcttgttgagttcctaacaagatttttatctgaattgcccttacgtgcctggtccaggtgaagtgtaaggtatcctccaaaggcaccctttgtttcacttttgaatagatttactaggaaatctaaatcaagccattgttattcagagccaaaaacctgatttatcacatttttaatcgtgaataggaaagaagatttttaaaaagcccaagtcgttgtattagctttaacaacaacaaaaaaaaggcattcatgaaccagtagaacagagcccattgaaaacatccagacctttcaaagcatttcaccagtttctagtaacattttaagaggggaaagttgcttgaccactttatcttgttagttgaagagccccaccacttaaatcagtgtaatttgttctcctatctttggggtattccttgttgacaccttaaggttttatttggaaggataatcactactaacgacaaagtacaaattttggcctctttaggacttaattttgttatgctaatcgcattaaagtagaagtataacattcaaatggagagggttggatttctagggctagacaaattgctactaaagtttgaaaaatcataaaggattttaattttagacaagaaatagaagactgtcagaaaaaaaaaaataggaagatctcgcccccccgcaaccaaaatggaaattctcaagatactatatacaagtcttaaaccagtttccccattgagaccatctctggagctgcacgtctttataaacgacccaagtctttaaagtcattgttttcccccaacggaataatattttaaaaaccatgaaaagttttggaaatgtgagaaataggctctgctggtttgaccctgattcactaattaaaatgatccctctcctgttattccctgagctctttgcaatattataagttaattcatatggttctgagcgattatgcaaaactaatttggactgtccaggggtaattatccctgacacggttaattaaatcctttcaaggcttcgtctttcccttttgtagcagcccatcccttctcaacacggaacttctgcggctcgctggaaatcaccccagccctaaatcttagttaccaccctgagccttccagctcggccgcctcctcggcctgaagactccccgcctcctcccgccccctccccttttcccaaagatcagcgttttctgggagaaacgctccggagttgttgatgaatgagaagaggactggaaagatgggtaagaggaggggtgaggatgccgagggggagcaccgaggtcatatcgccaacagattgtgcggctgtttgaggacctccacaggccccacagactcgtttatcacccattctgactccaatggtcttgctaacaagttggcgggttttgcgcctgcagagagcctcctgccaagttagactgtgcagaagtaaggggttggagcggggggagcggctccggggcaagagggcgtagagaaaggcccggggnngggnggtgtaagcgtctgaaagtggcccacaaatgcagcgctgtgattgggcagagagctgctgctggctcgcgatctctatctccatctctttatctatctccgtctctctccctgtttctccatttttctttctttccttctctctccttccttccttccatctttcttctttcccttccttttattcttctattttcgtttcttttcaaggttttttttaaagccatgatgcaatttctttggtattcaccgttgtcccaaaacttgaagcaagcctcgtatccaaggggccaggcatgttgcttcgggctttgtgcaaacaggtggaattgcgctgtgtaagcagtaagaactggtgctggggagctgtcgcgcgagggggtggctttgggagagcagggttgctggccgcgattgttacttcccttgacaatttcctcctccccctcccccaagaagataggagaaagcaccgcggatctccctctcaccccaggctcggggcgcagaagatggagagaagattccactctccccggagcagatagggacggtcgcgccagccaatcagagcgcggctcggcgccggcgctcccggccgcctgggccgccgtgtcctccaggcaagcgaagttcccgcaactcgtccgcctcgagggtccgcgtctttcttgcgcccgcggcccagcggaggccgagggagccgtccaaactttattaatctctcctcctttctttctccctcagcccagtgcatctcaaaggtcagccctcttcttttaaaagactgatattattaatgcactgacaattcctcccccccttttcttttttctctcttgcaggggggaaaaaaagggaaatggtgaaaagagctttttttatcctttttttttttttgtccttcagtgggagcgtttagacagtcgaggaggttttgtccgagaacaaaacgcagggttgggaggttttgtgagagtgttgtttgttgaagtggagctaagaaaaagcggcggctttctcctcattgtgaagaaaccaatcagtggtatttggaaaactgttagcattgtgcacttcttctgtgtccattgtgaggcgtttcttttcacaaggtttttttttcagccgatccagctggccggaatgaatagcggtgcaatgtgtacacgctttgtccctccggccttcaagtagcccccattgaatagactaagttgacctgcgtgacagtgaaacaacataataaaaaatacatgagcccctgaataggagcaggcgcataaataaataaaatgggtgaccaaaactggataaactgaatgacaaaacggtgaaaggggaacaaaaagatatttaacacgctagattagcattagaatgcgatctacaaggcagaacaattgatgaataggtttaccggccaagaaagaaatggactaaatgccctttgaatagatatgctttttgcaagggctttgaatagatatgcttttgcaagggctgaatgggaaaaggtaaagatgaagctatgcaaatgagccggggaactttttatatatattctttaaacacacacacacactgcggggggaagagtgctgcctcgggatgtttatagaagcaataattgccattattagcattgtctgcggcagatagaaattgaacaggttgggataatatagggtagcagtaattattcttctaattaatggtcctttgctacttgaaaaaagaaaaaaggaaagaagtagtaaaagttatgcagaagttatgtttccttgtgtccatttgcccagcgctggaatctgtggagcaggaagcctggcaattccaagatacgcgatgatcytcaaacattcccgggagccagtcctgaggctctggcttcagggcctagtttccatttatgccgcgtttttgagagtctaatactgtgtctggcacatggtaggtgctcactgaatagtcgtggtatgaatgaatgaacgaatgaatgaatgaatgaatgaatataagtttaatgggggaaacccgggcctcctaataaaggtaggggctgggggatacctaggggcttccccaggaggatttcttttttcatcatcccacccctgggagaaaggtccacgcaggatggtcgcttcccccttgctgagagttttgccttcagcctatctgggccgctggaaaagaggagaagaataaacaagagacaagcaactactcccctaccggcgttccgtccttgtcctcactgccaaatccactccaaagccgaggatggtgagactgtgaagttgcaaagaaacacagagcccacccccttaaagaattacgatatatttaaagtttgcctctttcaggtttctctccttggctcctgcccctttcccctcccggctccttgtccttgactgaacctcatgggacagagaacctcctgtcccccacgaggcaaggcgcgaacccgcagagatctggggtgccctttggttccctgcgctgccctggaggcgtccatagaggcctttgccgccaaggacagcaattgttttattttcgatggttgctcgccaggctgcgggtcgcgggcccacccagccgtcgaactttccagtcgttatcagcgctgctcctaacttaatggaataatgcaaattatagcctgcccagctgacacgtccctgcgaatgcgccggggctgagctctggccagccgctctctcgacgtcctggacggccggagggaatgaagctctgaattgtgacaaaagtggggggggcaccccaaattctcaaagcaatgttcttttttttttcttttttcttaagcaattgagccttaccaaatgtcggggccggccgcacggaagccttgcatattttaaagtgtaacctgagccttcgcggtttcagcttcacttaaaacatgcaaattcttgaaattgaaaaatctgaaaaacttccgaagagttctatctgaataaatccaaatccattgggagtcgctttgaggagacaaaacgcacagcgatttggggtgagggatatttgtggggaggcaggacgtgctggattgggtttccagggtcaaggtgtctctgggccttcgacgatagccttagcgcagagcagggaagtggcaccgctaggcagcaagctcagttgctctacttttgtgacccatccccccaccccccccaccgccacccttgcctccgggccactgcccctctctgcaagctt

SEQ ID NO: 1894 - DNA, 6942 bp, Homo sapiens
ggcatggaacctaaagactagaggcggttgtgtgagtcaggaagaggggccagatatctgagtgttcctctttagtttcttcaattgcagataatatggtgtctaattttatgttgttcaggaaagacagtggttcctgactcaggaagacagtctcagaaacatgtggaatgatattgagctgctaacaaatgatgataccggaagtgggtacctgagtgtcggttcaagaaaagaacatggaactgctttatatcaagtagatttgctagtgaagatctcttctgaaaaggcctcattaaatccaaagatacaggcatgcagcttaagtgatgggtttattattgtagccgaccaatcagtgatattgcttgacagtatttgtagatcacttcaattgcatcttgtctttgatactgaagtggatgtagttggcctttgtcaagaaggaaagtttcttttggttggcgagagaagtggcaacctacatcttattcatgtaacatcaaaacaaacactactcactaatgcatttgttcagaaagctaacgatgaaaatcggcggacttaccagaatcttgtcattgagaaggatggttcaaatgaaggtacctattatatgctacttcttacatacagtggatttttttgtattacaaaccttcagcttttaaaaattcaacaagcaattgagaatgtagacttcagtacagcaaaaaagttacaaggacaaatcaagtccagttttatttctactgaaaattatcatactcttggttgtctcagtcttgtggctggagatttagcaagtgaagttcctgtgataattgggggaaccggtaattgtgcattctcaaaatgggaaccagattcttccaagaaaggaatgacagttaagaaccttattgatgcagagattattaaaggtgcaaagaagttccagctgatagacaatctactttttgttcttgatactgataacgtgctgagtttatgggatatttacactctaactcctgtatggaactggccctctcttcacgtagaagagtttcttcttactacagaagcagactctccttcatcagtcacgtggcaaggaattacaaatctcaaattaatagctctgacagcttcagctaataagaagatgaaaaacctcatggtttattcattacctacaatggaaatactatattctttggaagtatctagtgtttcttctctggtccaaacaggaattagcacagataccatataccttttagaaggagtttgcaaaaatgatccaaaattgtctgaagactcagtctctgtgttagtactcagatgtcttacggaagctttaccagaaaacagattgagtcggttacttcacaaacacagatttgctgaagctgagagttttgccattcagtttggactagatgttgagcttgtttacaaggtcaagtcaaatcatatattggagaaactggcattgagttctgtggatgccagtgaacagaccgaatggcaacaacttgtagacgacgctaaggaaaatctacataagatccaggatgatgaatttgtggtgaattactgcctgaaagctcagtggataacctatgaaaccactcaagagatgctgaattatgccaaaaccaggcttttgaagaaagaagataaaactgctctcatttattctgatggcttgaaagaggtgctaagagctcatgcaaaattgactactttttatggagcatttggaccagaaaaattcagtggcagttcttggattgaatttctaaataatgaagatgatcttaaagatatttttttacagctaaaagaaggaaaccttgtttgtgcacagtatctttggcttcgacatcgggcaaactttgaaagcagatttgatgtgaaaatgctggagagcttgctcaactcaatgtctgcatcagtctctttgcaaaagctgtgtccatggtttaaaaatgatgtgattccatttgtaagaaggactgtgcctgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacctcatatttgatgccgtgctcaagatcatgtatgcggcagtggttccttggagtgcagctgtggagcaactggtgaaacagcacctggaaatggaccatcccaaagtcaagttattacaggaaagttacaaactaatggagatgaaaaaacttttacgaggctatggaataagagaggtaaatctcttaaacaaggaaataatgagagtggttagatacattctcaaacaagatgtcccatcttctttagaagatgctttaaaggtagcccaagcgtttatgttatctgatgatgagatctacagtctaagaattattgacctgattgatagagaacagggtgaagactgtctccttctgttgaagtctttgcctcctgctgaagctgagaaaactgcagaaagagtcatcatatgggcacgactggcattacaagaagagccagatcattctaaagagggcaaggcctggagaatgtctgtagcgaagacatccgtggacattcttaagatactatgtgacattcagaaagacaatctgcagaagaaggacgaatgtgaagaaatgttgaaactatttaaagaggttgctagcttacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcagcgacttgtttaagtatcactgcaatgctgacactgggaaattgctatttctgacatgtcagaagctttgtcagatgttggctgataatgtcccagtgacagtgcctgtgggactgaatcttccttccatgatacatgatctagcaagccaagctgccaccatttgcagtccagattttttactagatgctttagaactatgtaaacatactttaatggctgtagagctttccagacaatgccaaatggatgactgtggaatcctcatgaaagcttcttttgggacacataaagatccatatgaagagtggtcttacagtgacttcttcagtgaagatggaattgttcttgagtcacagatggtgcttccagtgatttatgaactgatttcatctcttgtgcctctagctgaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataagctggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagc

SEQ ID NO: 1895 - DNA, 884 bp, Homo sapiens
ttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttgaaaaaaaaaaaaaaaaaaaa

SEQ ID NO: 1896 - DNA, 787 bp, Homo sapiens
gtgtggacactcctaggatagaaagtttggtatgttgctatacctttgcttctcccaccttccccaatatctaatatgtatttctcattcttagaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagaaaaaaaaaaaaaaaa

SEQ ID NO: 1897 - DNA, 1838 bp, Homo sapiens
gtcgacggctggtttgaaaagtgacaacggccggtggattttaggagtttgctcggtttgtaactgctctttggtgagctactgggactgcagactaggaggagactcccaaaatggaaactctgtccttccccagatacaacatagctgagattgtagttcatattcgcaataaactgttaactggagcggatggcaaaaacctctccaagagcgattttcttccaaacccgaagcctgaagtcctgtacatgatttacatgagagccttacagttagtgtatggggtccggctggagcatttctacatgatgccggtgaacatagaagtcatgtatccacatataatggagggcttcttaccggtcagcaatttgttcttccacctggactcgtttatgcccatttgccgggtgaatgactttgagatcgccgatattctttatccaaaagcaaaccggacaagtcgttttttaagtggcattatcaactttattcacttcagagaaacatgcctggagaagtatgaagaatttcttttgcaaaataaatcctctgtggacaaaatacagcagttaagcaatgcacaccaggaagcattgatgaaactggaaaaactcaattcggttcccgtggaggagcaggaagagttcaaacagctgaaggatgacatccaggagctgcagcacttgctgaatcaagacttcagacagaaaacgacactgctgcaggagagatataccaaaatgaaatcagatttttcagagaaaaccaagcatgttaatgagctaaagttgtcagtagtttctttgaaagaagttcaagacagtttgaaaagcaaaattgtggattctccagagaagctgaagaactataaagagaagatgaaggacaccgtccagaagctccgcagtgccagggaagaagtgatggagaagtatgatatctatagagattctgtggattgcttgccttcctgtcagctggaggtgcagttatatcaaaagaaatcacaggaccttgcagataatagggagaaactaagcagtatcttaaaggagagcctgaacctggagggccagattgatagtgattcatcagaactaaagaaactgaagactgaagagaactccctcataagactgatgactctaaagaaggagagacttgctaccatgcagttcaaaataaacaagaagcaggaggatgtgaaacagtacaagcggaccatgattgaagattgcaataaagttcaagaaaaaagagatgctgtctgcgagcaagtaaccgccattaatcaagacatccacaagattaaatctgggattcagcagctaagagacgccgaaaaacgggagaaactgaagtctcaggaaatcttggtagacttgaaaagtgctttggagaagtaccatgagggcatcgagaagacgacggaggagtgctgcactagaataggagggaagactgccgagctgaagaggaggatgttcaaaatgccgccctgatcaacagccacccgaaaatggcctttcgctttctgtttggagtagttatattgaagctaatagaaggaccgcagtctcagctaactagcgtgggtaccattggttctctgtccttttatgaccatgtgctccctgtgtttttttcttggtgatggggatacaactcagggccttgcaggctacactgacttgcctccctaggctctaatgtaccatgtactatgtaggcttttgctacaattaaagtaacgtgtacagcttttatgtccctactctgtctccttttgtatgtgctggttggaataaacaaatagttactgacgtcaaaaa

SEQ ID NO: 1898 - DNA, 2103 bp, Homo sapiens
ctctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctagggggggatcagctacaaaagaaactgtcactgggagcggtgcggccaaggaggaagcagtgctgccaggctctgctccagggcacagctggctggcggctgccctgtccgcagcaaaggggcacaggccggggaccgcgagaggtggcaaagtggcaccgggcgccgaggctgctgagcgctcgccgagacgcggaccggactggctgccccggaactgcggcgactctccctactcagaacttggcctacgtttcccaggactctccccatctccagaggcccccacaaaaccgggaaaggaaggaaaggacagcggcggcagcagctcaatgagtgcctacagcagaaagcctgaacgagctcggtcgtaggcgggaagttcccgggggctgcccagtgcagccgcaatgctgccgcgagctgccccagcagtccgggctccgtagacgctttccgcatcactctccttcctcgggctgccgggagtcccgggacctggcggggccggcatgacgggcttctcgggggcccgccgcacgcccggcagcctccggagacgcgcgccgagcccggctcccacggcctctgaggctcggcggggctgcggctgcctggcgggcgggctccggagctttcctgagccggcattagcccacggcttggcccggacgcgaccaaaggctcttctggagaagcccagagcactgggcaatcgttacgacctgtaacttgagggccaccgaactgctactcccgttcgcctttggcgatcatcttttaaccctccggagcacgtcagcatccagccaccgcggcgctctcccagcagcggaggacccaggactatcccttcggcgagacggatggaaaccgagccccctggaggacctgcccctgcagttctgcctcacacggctcaagtcaccaccgtgaacaagggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggtcacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggtttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacaggaaaaaaaaaaaaaaaaaa

SEQ ID NO: 1899 - DNA, 987 bp, Homo sapiens
cggagagggggagaacagacaacgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatataagccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactc

SEQ ID NO: 1900 - DNA, 2545 bp, Homo sapiens
atccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcag

SEQ ID NO: 1901 - protein, 149 aa, Homo sapiens
MASSDIQVKELEKRASGQAFELILSPRSKESVPEFPLSPPKKKDLSLEEIQKKLEAAEERRKSHEAEVLKQLAEKREHEKEVLQKAIEENNNFSKMAEEKLTHKMEANKENREAQMAAKLERLREKDKHIEEVRKNKESKDPADETEAD

SEQ ID NO: 1902 - protein, 276 aa, Homo sapiens
MSKPVDHVKRPMNAFMVWSRAQRRKMAQENPKMHNSEISKRLGAEWKLLTESEKRPFIDEAKRLRAMHMKEHPDYKYRPRRKPKTLLKKDKFAFPVPYGLGGVADAEHPALKAGAGLHAGAGGGLVPESLLANPEKAAAAAAAAAARVFFPQSAAAAAAAAAAAAAGSPYSLLDLGSKMAEISSSSSGLPYASSLGYPTAGAGAFHGAAAAAAAAAAAAGGHTHSHPSPGNPGYMIPCNCSAWPSPGLQPPLAYILLPGMGKPQLDPYPAAYAAAL

SEQ ID NO: 1903 - protein, 2209 aa, Homo sapiens
MWNDIELLTNDDTGSGYLSVGSRKEHGTALYQVDLLVKISSEKASLNPKIQACSLSDGFIIVADQSVILLDSICRSLQLHLVFDTEVDVVGLCQEGKFLLVGERSGNLHLIHVTSKQTLLTNAFVQKANDENRRTYQNLVIEKDGSNEGTYYMLLLTYSGFFCITNLQLLKIQQAIENVDFSTAKKLQGQIKSSFISTENYHTLGCLSLVAGDLASEVPVIIGGTGNCAFSKWEPDSSKKGMTVKNLIDAEIIKGAKKFQLIDNLLFVLDTDNVLSLWDIYTLTPVWNWPSLHVEEFLLTTEADSPSSVTWQGITNLKLIALTASANKKMKNLMVYSLPTMEILYSLEVSSVSSLVQTGISTDTIYLLEGVCKNDPKLSEDSVSVLVLRCLTEALPENRLSRLLHKHRFAEAESFAIQFGLDVELVYKVKSNHILEKLALSSVDASEQTEWQQLVDDAKENLHKIQDDEFVVNYCLKAQWITYETTQEMLNYAKTRLLKKEDKTALIYSDGLKEVLRAHAKLTTFYGAFGPEKFSGSSWIEFLNNEDDLKDIFLQLKEGNLVCAQYLWLRHRANFESRFDVKMLESLLNSMSASVSLQKLCPWFKNDVIPFVRRTVPEGQIILAKWLEQAARNLELTDKANWPENGLQLAEIFFTAEKTDELGLASSWHWISLKDYQNTEEVCQLRTLVNNLRELITLHRKYNCKLALSDFEKENTTTIVFRMFDKVLAPELIPSILEKFIRVYMREHDLQEEELLLLYIEDLLNRCSSKSTSLFETAWEAKAMAVIACLSDTDLIFDAVLKIMYAAVVPWSAAVEQLVKQHLEMDHPKVKLLQESYKLMEMKKLLRGYGIREVNLLNKEIMRVVRYILKQDVPSSLEDALKVAQAFMLSDDEIYSLRIIDLIDREQGEDCLLLLKSLPPAEAEKTAERVIIWARLALQEEPDHSKEGKAWRMSVAKTSVDILKILCDIQKDNLQKKDECEEMLKLFKEVASLQENFEVFLSFEDYSNSSLVADLREQHIKAHEVAQAKHKPGSTPEPIAAEVRSPSMESKLHRQALALQMSKQELEAELTLRALKDGNIKTALKKCSDLFKYHCNADTGKLLFLTCQKLCQMLADNVPVTVPVGLNLPSMIHDLASQAATICSPDFLLDALELCKHTLMAVELSRQCQMDDCGILMKASFGTHKDPYEEWSYSDFFSEDGIVLESQMVLPVIYELISSLVPLAESKRYPLESTSLPYCSLNEGDGLVLPVINSISALLQNLQESSQWELALRFVVGSFGTCLQHSVSNFMNATLSEKLFGETTLVKSRHVVMELKEKAVIFIRENATTLLHKVFNCRLVDLDLALGYCTLLPQKDVFENLWKLIDKAWQNYDKILAISLVGSELASLYQEIEMGLKFRELSTDAQWGIRLGKLGISFQPVFRQHFLTKKDLIKALVENIDMDTSLILEYCSTFQLDCDAVLQLFIETLLHNTNAGQGQGDASMDSAKRRHPKLLAKALEMVPLLTSTKDLVISLSGILHKLDPYDYEMIEVVLKVIERADEKITNININQALSILKHLKSYRRISPPVDLEYQYMLEHVITLPSAAQTRLPFHLIFFGTAQNFWKILSTELSEESFPTLLLISKLMKFSLDTLYVSTAKHVFEKKLKPKLLKLTQAKSSTLINKEITKITQTIESCLLSIVNPEWAVAIAISLAQDIPEGSFKISALKFCLYLAERWLQNIPSQDEKREKAEALLKKLHIQYRRSGTEAVLIAHKLNTEEYLRVIGKPAHLIVSLYEHPSINQRIQNSSGTDYPDIHAAAKEIAEVNEINLEKVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 1904 - protein, 197 aa, Homo sapiens
MQRASRLKRELHMLATEPPPGITCWQDKDQMDDLRAQILGGANTPYEKGVFKLEVIIPERYPFEPPQIRFLTPIYHPNIDSAGRICLDVLKLPPKGAWRPSLNIATVLTSIQLLMSEPNPDDPLMADISSEFKYNKPAFLKNARQWTEKHARQKQKADEEEMLDNLPEAGDSRVHNSTQKRKASQLVGIEKKFHPDV

SEQ ID NO: 1905 - protein, 202 aa, Homo sapiens
MATLIYVDKENGEPGTRVVAKDGLKLGSGPSIKALDGRSQVSTPRFGKTFDAPPALPKATRKALGTVNRATEKSVKTKGPLKQKQPSFSAKKMTEKTVKAKSSVPASDDAYPEIEKFFPFNPLDFESFDLPEEHQIAHLPLSGVPLMILDEERELEKLFQLGPPSPVKMPSPPWESNLLQSPSSILSTLDVELPPVCCDIDI

SEQ ID NO: 1906 - protein, 464 aa, Homo sapiens
METLSFPRYNIAEIVVHIRNKLLTGADGKNLSKSDFLPNPKPEVLYMIYMRALQLVYGVRLEHFYMMPVNIEVMYPHIMEGFLPVSNLFFHLDSFMPICRVNDFEIADILYPKANRTSRFLSGIINFIHFRETCLEKYEEFLLQNKSSVDKIQQLSNAHQEALMKLEKLNSVPVEEQEEFKQLKDDIQELQHLLNQDFRQKTTLLQERYTKMKSDFSEKTKHVNELKLSVVSLKEVQDSLKSKIVDSPEKLKNYKEKMKDTVQKLRSAREEVMEKYDIYRDSVDCLPSCQLEVQLYQKKSQDLADNREKLSSILKESLNLEGQIDSDSSELKKLKTEENSLIRLMTLKKERLATMQFKINKKQEDVKQYKRTMIEDCNKVQEKRDAVCEQVTAINQDIHKIKSGIQQLRDAEKREKLKSQEILVDLKSALEKYHEGIEKTTEECCTRIGGKTAELKRRMFKMPP

SEQ ID NO: 1907 - protein, 168 aa, Homo sapiens
MAEPWGNELASAAARGDLEQLTSLLQNNVNVNAQNGFGRTALQVMKLGNPEIARRLLLRGANPDLKDRTGFAVIHDAARAGFLDTLQTLLEFQADVNIEDNEGNLPLHLAAKEGHLRVVEFLVKHTASNVGHRNHKGDTACDLARLYGRNEVVSLMQANGAGGATNLQ

SEQ ID NO: 1908 - protein, 156 aa, Homo sapiens
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 1909 - protein, 125 aa, Homo sapiens
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 1910 - DNA, 931 bp, Homo sapiens
caacagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcrcgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttgaaaaaaaaaaaaaaaaaaaa

SEQ ID NO: 1911 - DNA, 27 bp, Artificial Sequence
  PCR primer
gctaaaggtgaccccaagaaaccaaag

SEQ ID NO: 1912 - DNA, 37 bp, Artificial Sequence; identical to SEQ ID NO: 1666
  PCR primer

SEQ ID NO: 1913 - protein, 207 aa, Homo sapiens; identical to SEQ ID NO: 1667

SEQ ID NO: 1914 - DNA, 624 bp, Homo sapiens
atgcagcatcaccaccatcaccacgctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtccagctaaagttgcccggaaaaaggtggaagaggaagatgaagaagaggaggaggaagaagaggaggaggaggaggaggaggatgaataa

SEQ ID NO: 1915 - DNA, 28 bp, Artificial Sequence
  PCR primer
gtgacgatggaggagctgcgggagatgg

SEQ ID NO: 1916 - DNA, 30 bp, Artificial Sequence
  PCR primer
cgcctaactcgagtcactaacagctgggag

SEQ ID NO: 1917 - protein, 401 aa, Homo sapiens
MQHHHHHHVTMEELREMDCSVLKRLMNRDENGGGAGGSGSHGTLGLPSGGKCLLLDCRPFLAHSAGYILGSVNVRCNTIVRRRAKGSVSLEQILPAEEEVRARLRSGLYSAVIVYDERSPRAESLREDSTVSLVVQALRRNAERTDICLLKGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 1918 - DNA, 1209 bp, Homo sapiens
atgcagcatcaccaccatcaccacgtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagtgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagtga

SEQ ID NO: 1919 - DNA, 23 bp, Artificial Sequence
  PCR primer
cggtgccacgcccatggaccttc

SEQ ID NO: 1920 - DNA, 35 bp, Artificial Sequence
  PCR primer
ctgagaattcattaaacttgtggttgctcttcacc

SEQ ID NO: 1921 - protein, 167 aa, Homo sapiens [sequence omitted]

SEQ ID NO: 1922 - DNA, 507 bp, Homo sapiens
atgcagcatcaccaccatcaccaccggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcgacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaatga

SEQ ID NO: 1923 - DNA, 3192 bp, Homo sapiens
cccacgcgtccggcggtcgccgcgggatttggagctgcctagcctcgcggtcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcagggcagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggtttaaggagttcatgagtaaacatgttcacttaatgtgttaccggatctgcgtgcgagcgctgacagccatcatcacctaccatgacagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatgaaaaaaaaaa

SEQ ID NO: 1924 - DNA, 2048 bp, Homo sapiens
  misc_feature 787, 1453, 1521, 1727: n = A,T,C or G
gccggaagcgcgcggagaccatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagccttggttccatcggtgtgctgcgccggacaggagctaatcatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtngtggctggctgtgggatcctgttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctdvgcccnatttcagcaccctgccacttggagtggacccctcctactcttcttagcgcctaccctcatacctatcntccctcctcccatctcctagggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgcctttttttttgttncccggatcctggggtggggcagaaatattttctgggctggggtaggaggaaggttgttagcatctactgctgccgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagacaaaaaaaaaaaaa

SEQ ID NO: 1925 - protein, 456 aa, Homo sapiens
MFLLLPFDSLIVNLLGISLTVLFTLLLVFIIVPAIFGVSFGIRKLYMKSLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCFLLPLRIALAFTGISLLVVGTTVVGYLPNGRFKEFMSKHVHLMCYRICVRALTAIITYHDRENRPRNGGICVANHTSPIDVIILASDGYYAMVGQVHGGLMGVIQRAMVKACPHVWFERSEVKDRHLVAKRLTEHVQDKSKLPILIFPEGTCINNTSVMMFKKGSFEIGATVYPVAIKYDPQFGDAFWNSSKYGMVTYLLRMMTSWAIVCSVWYLPPMTREADEDAVQFANRVKSAIARQGGLVDLLWDGGLKREKVKDTFKEEQQKLYSKMIVGNHKDRSRS

SEQ ID NO: 1926 - protein, 324 aa, Homo sapiens
MGPWGEPELLVWRPEAVASEPPVPVGLEVKLGALVLLLVLTLLCSLGSIGVLRRTGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLFIQI

SEQ ID NO: 1927 - protein, 15 aa, Homo sapiens
GPRSGGAQAKLGCCW

SEQ ID NO: 1928 - protein, 20 aa, Homo sapiens
KVICKSCISQTPGINLDLGS

SEQ ID NO: 1929 - protein, 20 aa, Homo sapiens
IIPKEEHCKMPEAGEEQPQV

SEQ ID NO: 1930 - protein, 24 aa, Homo sapiens
LSIPHPYAYPDYYPYAWFGVNPGM

SEQ ID NO: 1931 - DNA, 1526 bp, Homo sapiens
actggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgttggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttaaaaaaaaaaaaaaaaaaaaaa

SEQ ID NO: 1932 - protein, 404 aa, Homo sapiens
LEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTIVLQEGNSQKKSNISEKTKRLNELKLLVVSLKEIQESLKTKIVDSPEKLKNYKEKMKDTVQKLKNARQEVVEKYEIYGDSVDCLPSCQLEVQLYQKKIQDLSDNREKLASILKESLNLEDQIESDESELKKLKTEENSFKRLMIVKKEKLATAQFKINKKHEDVKQYKRTVIEDCNKVQEKRGAVYERVTTINQEIQKIKLGIQQLKDAAEREKLKSQEIFLNLKTALEKYHDGIEKAAEDSYAKIDEKTAELKRKMFKMST

SEQ ID NO: 1933 - DNA, 1836 bp, Homo sapiens
ggcacgagggcaagtttgaaaagtgatgacggttgacgtttgctgatttttgactttgcttgtagctgctccccgaactcgccgtcttcctgtcggcggccggcactgtagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggtattcaggagctacaacaatcactaaatcaggattttcatcaaaaaacgatagtgctgcaagagggaaattcccaaaagaagtcaaatatttcagagaaaaccaagcgtttgaatgaactaaaattgttggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttaaaaaaaaaaaaaaaaaaaaaa

SEQ ID NO: 1934 - protein, 464 aa, Homo spaiens
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTIVLQEGNSQKKSNISEKTKRLNELKLLVVSLKEIQESLKTKIVDSPEKLKNYKEKMKDTVQKLKNARQEVVEKYEIYGDSVDCLPSCQLEVQLYQKKIQDLSDNREKLASILKESLNLEDQIESDESELKKLKTEENSFKRLMIVKKEKLATAQFKINKKHEDVKQYKRTVIEDCNKVQEKRGAVYERVTTINQEIQKIKLGIQQLKDAAEREKLKSQEIFLNLKTALEKYHDGIEKAAEDSYAKIDEKTAELKRKMFKMST

SEQ ID NO: 1935 - DNA, 26 bp, Artificial Sequence
  PCR primer
ctatgttggcatgcggtgccacgccc

SEQ ID NO: 1936 - DNA, 32 bp, Artificial Sequence
  PCR primer
cacgcctaagatcttcattaaacttgtggttg

SEQ ID NO: 1937 - protein, 159 aa, Homo sapiens
RCHAHGPSCLVTAITREEGGPRSGGAQAKLGCCWGYPSPRSTWNPDRRFWTPQTGPGEGRHERHTQTQNHTASPRSPVMESPKKKNQQLKVGILHLGSRQKKIRIQLRSQCATWKVICKSCISQTPGINLDLGSGVKVKIIPKEEHCKMPEAGEEQPQV

SEQ ID NO: 1938 - DNA, 486 bp, Homo sapiens
atgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcgacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaatga

SEQ ID NO: 1939 - DNA, 28 bp, Artificial Sequence
  PCR primer
ctatgttgcatatatgcggtgccacgcc

SEQ ID NO: 1940 - protein, 160 aa, Homo sapiens; identical to SEQ ID NO: 809

SEQ ID NO: 1941 - DNA, 486 bp, Homo sapiens; identical to SEQ ID NO: 1938

SEQ ID NO: 1942 - protein, 19 aa, Homo sapiens
LGCCWGYPSPRSTWNDRPF

SEQ ID NO: 1943 - protein, 20 aa, Homo sapiens
CSLGVFPSAPSPVWGTRRSC

SEQ ID NO: 1944 - protein, 20 aa, Homo sapiens
ILSPLLRHGGHTQTQNHTAS

SEQ ID NO: 1945 - protein, 20 aa, Homo sapiens
MRCHAHGPSCLVTAITREEG

SEQ ID NO: 1946 - protein, 20 aa, Homo sapiens
HGPSCLVTAITREEGGPRSG

SEQ ID NO: 1947 - protein, 20 aa, Homo sapiens
LVTAITREEGGPRSGGAQAK

SEQ ID NO: 1948 - protein, 20 aa, Homo sapiens
TREEGGPRSGGAQAKLGCCW

SEQ ID NO: 1949 - protein, 20 aa, Homo sapiens
GPRSGGAQAKLGCCWGYPSP

SEQ ID NO: 1950 - protein, 20 aa, Homo sapiens
GAQAKLGCCWGYPSPRSTWN

SEQ ID NO: 1951 - protein, 20 aa, Homo sapiens
LGCCWGYPSPRSTWNPDRRF

SEQ ID NO: 1952 - protein, 20 aa, Homo sapiens
GYPSPRSTWNPDRRFWTPQT

SEQ ID NO: 1953 - protein, 20 aa, Homo sapiens
RSTWNPDRRFWTPQTGPGEG

SEQ ID NO: 1954 - protein, 20 aa, Homo sapiens
PDRRFWTPQTGPGEGRHERH

SEQ ID NO: 1955 - protein, 20 aa, Homo sapiens
WTPQTGPGEGRHERHTQTQN

SEQ ID NO: 1956 - protein, 20 aa, Homo sapiens
GPGEGRHERHTQTQNHTASP

SEQ ID NO: 1957 - protein, 20 aa, Homo sapiens
RHERHTQTQNHTASPRSPVM

SEQ ID NO: 1958 - protein, 20 aa, Homo sapiens
TQTQNHTASPRSPVMESPKK

SEQ ID NO: 1959 - protein, 20 aa, Homo sapiens
HTASPRSPVMESPKKKNQQL

SEQ ID NO: 1960 - protein, 20 aa, Homo sapiens
RSPVMESPKKKNQQLKVGIL

SEQ ID NO: 1961 - protein, 20 aa, Homo sapiens
ESPKKKNQQLKVGILHLGSR

SEQ ID NO: 1962 - protein, 20 aa, Homo sapiens
KNQQLKVGILHLGSRQKKIR

SEQ ID NO: 1963 - protein, 20 aa, Homo sapiens
KVGILHLGSRQKKIRIQLRS

SEQ ID NO: 1964 - protein, 20 aa, Homo sapiens
HLGSRQKKIRIQLRSQCATW

SEQ ID NO: 1965 - protein, 21 aa, Homo sapiens
RQKKIRIQLRSQCATWKVICK

SEQ ID NO: 1966 - protein, 20 aa, Homo sapiens
IQLRSQCATWKVICKSCISQ

SEQ ID NO: 1967 - protein, 21 aa, Homo sapiens
SQCATWKVICKSCISQTPGIN

SEQ ID NO: 1968 - protein, 20 aa, Homo sapiens
KVICKSCISQTPGINLDLGS

SEQ ID NO: 1969 - protein, 20 aa, Homo sapiens
SCISQTPGINLDLGSGVKVK

SEQ ID NO: 1970 - protein, 20 aa, Homo sapiens
TPGINLDLGSGVKVKIIPKE

SEQ ID NO: 1971 - protein, 20 aa, Homo sapiens
LDLGSGVKVKIIPKEEHCKM

SEQ ID NO: 1972 - protein, 20 aa, Homo sapiens
GVKVKIIPKEEHCKMPEAGE

SEQ ID NO: 1973 - protein, 20 aa, Homo sapiens
IIPKEEHCKMPEAGEEQPQV

SEQ ID NO: 1974 - DNA, 60 bp, Homo sapiens
atgcggtgccacgcccatggaccttcttgtctcgtcacggccataactagggaggaagga

SEQ ID NO: 1975 - DNA, 60 bp, Homo sapiens
catggaccttcttgtctcgtcacggccataactagggaggaaggagggccgaggagtgga

SEQ ID NO: 1976 - DNA, 60 bp, Homo sapiens
ctcgtcacggccataactagggaggaaggagggccgaggagtggaggggctcaggcgaag

SEQ ID NO: 1977 - DNA, 60 bp, Homo sapiens
actagggaggaaggagggccgaggagtggaggggctcaggcgaagctggggtgctgttgg

SEQ ID NO: 1978 - DNA, 60 bp, Homo sapiens
gggccgaggagtggaggggctcaggcgaagctggggtgctgttgggggtatccgagtccc

SEQ ID NO: 1979 - DNA, 60 bp, Homo sapiens
ggggctcaggcgaagctggggtgctgttgggggtatccgagtcccagaagcacctggaac

SEQ ID NO: 1980 - DNA, 60 bp, Homo sapiens
ctggggtgctgttgggggtatccgagtcccagaagcacctggaaccccgacagaagattc

SEQ ID NO: 1981 - DNA, 60 bp, Homo sapiens
gggtatccgagtcccagaagcacctggaaccccgacagaagattctggactccccagacg

SEQ ID NO: 1982 - DNA, 60 bp, Homo sapiens
agaagcacctggaaccccgacagaagattctggactccccagacgggaccaggagaggga

SEQ ID NO: 1983 - DNA, 60 bp, Homo sapiens
cccgacagaagattctggactccccagacgggaccaggagagggacggcatgagcgacac

SEQ ID NO: 1984 - DNA, 60 bp, Homo sapiens
tggactccccagacgggaccaggagagggacggcatgagcgacacacacaaacacagaac

SEQ ID NO: 1985 - DNA, 60 bp, Homo sapiens
ggaccaggagagggacggcatgagcgacacacacaaacacagaaccacacagccagtccc

SEQ ID NO: 1986 - DNA, 61 bp, Homo sapiens
cggcatgagcgacacaacacaaacacagaaccacacagccagtcccaggagcccagtaatg

SEQ ID NO: 1987 - DNA, 60 bp, Homo sapiens
acacaaacacagaaccacacagccagtcccaggagcccagtaatggagagccccaaaaag

SEQ ID NO: 1988 - DNA, 60 bp, Homo sapiens
cacacagccagtcccaggagcccagtaatggagagccccaaaaagaagaaccagcagctg

SEQ ID NO: 1989 - DNA, 60 bp, Homo sapiens
aggagcccagtaatggagagccccaaaaagaagaaccagcagctgaaagtcgggatccta

SEQ ID NO: 1990 - DNA, 60 bp, Homo sapiens
gagagccccaaaaagaagaaccagcagctgaaagtcgggatcctacacctgggcagcaga

SEQ ID NO: 1991 - DNA, 60 bp, Homo sapiens
aagaaccagcagctgaaagtcgggatcctacacctgggcagcagacagaagaagatcagg

SEQ ID NO: 1992 - DNA, 60 bp, Homo sapiens
aaagtcgggatcctacacctgggcagcagacagaagaagatcaggatacagctgagatcc

SEQ ID NO: 1993 - DNA, 60 bp, Homo sapiens
cacctgggcagcagacagaagaagatcaggatacagctgagatcccagtgcgcgacatgg

SEQ ID NO: 1994 - DNA, 63 bp, Homo sapiens
agacagaagaagatcaggatacagctgagatcccagtgcgcgacatggaaggtgatctgcaag

SEQ ID NO: 1995 - DNA, 60 bp, Homo sapiens
atacagctgagatcccagtgcgcgacatggaaggtgatctgcaagagctgcatcagtcaa

SEQ ID NO: 1996 - DNA, 63 bp, Homo sapiens
tcccagtgcgcgacatggaaggtgatctgcaagagctgcatcagtcaaacaccggggataaat

SEQ ID NO: 1997 - DNA, 60 bp, Homo sapiens
aaggtgatctgcaagagctgcatcagtcaaacaccggggataaatctggatttgggttcc

SEQ ID NO: 1998 - DNA, 60 bp, Homo sapiens
agctgcatcagtcaaacaccggggataaatctggatttgggttccggcgtcaaggtgaag

SEQ ID NO: 1999 - DNA, 60 bp, Homo sapiens
acaccggggataaatctggatttgggttccggcgtcaaggtgaagataatacctaaagag

SEQ ID NO: 2000 - DNA, 60 bp, Homo sapiens
ctggatttgggttccggcgtcaaggtgaagataatacctaaagaggaacactgtaaaatg

SEQ ID NO: 2001 - DNA, 60 bp, Homo sapiens
ggcgtcaaggtgaagataatacctaaagaggaacactgtaaaatgccagaagcaggtgaa

SEQ ID NO: 2002 - DNA, 60 bp, Homo sapiens
ataatacctaaagaggaacactgtaaaatgccagaagcaggtgaagagcaaccacaagtt

SEQ ID NO: 2003 - DNA, 753 bp, Homo sapiens
atgaattcgatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcaggatctctctccgtggcagcagaaaatcagccatattcttattgcctgctgtctggcagtttgggcttgaacatcgtcagtgcaatctgctctgcagttggagtcatactcttcatcacagatctaagtattccccacccatatgcctaccccgactattatccttacgcctggggtgtgaaccctggaatggcgatttctggcgtgctgctggtcttctgcctcctggagtttggcatcgcatgcgcatcttcccactttggctgccagttggtctgctgtcaatcaagcaatgtgagtgtcatctatccaaacatctatgcagcaaacccagtgatcaccccagaaccggtgacctcaccaccaagttattccagtgagatccaagcaaataagtaa

SEQ ID NO: 2004 - protein, 250 aa, Homo sapiens; identical to SEQ ID NO: 1677

SEQ ID NO: 2005 - protein, 20 aa, Homo sapiens
HLGSRQKKIRIQLRSQCATW

SEQ ID NO: 2006 - protein, 29 aa, Homo sapiens
TREEGGPRSGGAQAKLGCCWGYPSPRSTW

SEQ ID NO: 2007 - protein, 30 aa, Homo sapiens
RSPVMESPKKKNQQLKVGILHLGSRQKKIR

SEQ ID NO: 2008 - protein, 30 aa, Homo sapiens
IQLRSQCATWKVICKSCISQTPGINLDLGS

SEQ ID NO: 2009 - protein, 30 aa, Homo sapiens
SCISQTPGINLDLGSGVKVKIIPKEEHCKM

SEQ ID NO: 2010 - protein, 20 aa, Homo sapiens
RSAVEYIRALQQLLDEHDAV

SEQ ID NO: 2011 - protein, 20 aa, Homo sapiens
QQPFLPPAACFFATAAAAAA

SEQ ID NO: 2012 - protein, 20 aa, Homo sapiens
MVQQTNNAENTEALLAGESS

SEQ ID NO: 2013 - protein, 20 aa, Homo sapiens
NNAENTEALLAGESSDSGAG

SEQ ID NO: 2014 - protein, 20 aa, Homo sapiens
TEALLAGESSDSGAGLELGI

SEQ ID NO: 2015 - protein, 20 aa, Homo sapiens
AGESSDSGAGLELGIASSPT

SEQ ID NO: 2016 - protein, 20 aa, Homo sapiens
DSGAGLELGIASSPTPGSTA

SEQ ID NO: 2017 - protein, 20 aa, Homo sapiens
LELGIASSPTPGSTASTGGK

SEQ ID NO: 2018 - protein, 20 aa, Homo sapiens
ASSPTPGSTASTGGKADDPS

SEQ ID NO: 2019 - protein, 20 aa, Homo sapiens
PGSTASTGGKADDPSWCKTP

SEQ ID NO: 2020 - protein, 20 aa, Homo sapiens
STGGKADDPSWCKTPSGHIK

SEQ ID NO: 2021 - protein, 20 aa, Homo sapiens
ADDPSWCKTPSGHIKRPMNA

SEQ ID NO: 2022 - protein, 20 aa, Homo sapiens
WCKTPSGHIKRPMNAFMVWS

SEQ ID NO: 2023 - protein, 20 aa, Homo sapiens
SGHIKRPMNAFMVWSQIERR

SEQ ID NO: 2024 - protein, 20 aa, Homo sapiens
RPMNAFMVWSQIERRKIMEQ

SEQ ID NO: 2025 - protein, 20 aa, Homo sapiens
FMVWSQIERRKIMEQSPDMH

SEQ ID NO: 2026 - protein, 20 aa, Homo sapiens
QIERRKIMEQSPDMHNAEIS

SEQ ID NO: 2027 - protein, 20 aa, Homo sapiens
KIMEQSPDMHNAEISKRLGK

SEQ ID NO: 2028 - protein, 20 aa, Homo sapiens
SPDMHNAEISKRLGKRWKLL

SEQ ID NO: 2029 - protein, 20 aa, Homo sapiens
NAEISKRLGKRWKLLKDSDK

SEQ ID NO: 2030 - protein, 20 aa, Homo sapiens
KRLGKRWKLLKDSDKIPFIR

SEQ ID NO: 2031 - protein, 20 aa, Homo sapiens
RWKLLKDSDKIPFIREAERL

SEQ ID NO: 2032 - protein, 20 aa, Homo sapiens
KDSDKIPFIREAERLRLKHM

SEQ ID NO: 2033 - protein, 20 aa, Homo sapiens
IPFIREAERLRLKHMADYPD

SEQ ID NO: 2034 - protein, 20 aa, Homo sapiens
EAERLRLKHMADYPDYKYRP

SEQ ID NO: 2035 - protein, 20 aa, Homo sapiens
RLKHMADYPDYKYRPRKKVK

SEQ ID NO: 2036 - protein, 20 aa, Homo sapiens
ADYPDYKYRPRKKVKSGNAN

SEQ ID NO: 2037 - protein, 20 aa, Homo sapiens
YKYRPRKKVKSGNANSSSSA

SEQ ID NO: 2038 - protein, 20 aa, Homo sapiens
RKKVKSGNANSSSSAAASSK

SEQ ID NO: 2039 - protein, 20 aa, Homo sapiens
SGNANSSSSAAASSKPGEKG

SEQ ID NO: 2040 - protein, 20 aa, Homo sapiens
SSSSAAASSKPGEKGDKVGG

SEQ ID NO: 2041 - protein, 20 aa, Homo sapiens
AASSKPGEKGDKVGGSGGGG

SEQ ID NO: 2042 - protein, 20 aa, Homo sapiens
PGEKGDKVGGSGGGGHGGGG

SEQ ID NO: 2043 - protein, 20 aa, Homo sapiens
DKVGGSGGGGHGGGGGGGSS

SEQ ID NO: 2044 - protein, 20 aa, Homo sapiens
SGGGGHGGGGGGGSSNAGGG

SEQ ID NO: 2045 - protein, 20 aa, Homo sapiens
HGGGGGGGSSNAGGGGGGAS

SEQ ID NO: 2046 - protein, 20 aa, Homo sapiens
GGGSSNAGGGGGGASGGGAN

SEQ ID NO: 2047 - protein, 20 aa, Homo sapiens
NAGGGGGGASGGGANSKPAQ

SEQ ID NO: 2048 - protein, 20 aa, Homo sapiens
GGGASGGGANSKPAQKKSCG

SEQ ID NO: 2049 - protein, 20 aa, Homo sapiens
GGGANSKPAQKKSCGSKVAG

SEQ ID NO: 2050 - protein, 20 aa, Homo sapiens
SKPAQKKSCGSKVAGGAGGG

SEQ ID NO: 2051 - protein, 20 aa, Homo sapiens
KKSCGSKVAGGAGGGVSKPH

SEQ ID NO: 2052 - protein, 20 aa, Homo sapiens
SKVAGGAGGGVSKPHAKLIL

SEQ ID NO: 2053 - protein, 20 aa, Homo sapiens
GAGGGVSKPHAKLILAGGGG

SEQ ID NO: 2054 - protein, 20 aa, Homo sapiens
VSKPHAKLILAGGGGGGKAA

SEQ ID NO: 2055 - protein, 20 aa, Homo sapiens
AKLILAGGGGGGKAAAAAAA

SEQ ID NO: 2056 - protein, 20 aa, Homo sapiens
AGGGGGGKAAAAAAASFAAE

SEQ ID NO: 2057 - protein, 20 aa, Homo sapiens
GGKAAAAAAASFAAEQAGAA

SEQ ID NO: 2058 - protein, 20 aa, Homo sapiens
AAAAASFAAEQAGAAALLPL

SEQ ID NO: 2059 - protein, 20 aa, Homo sapiens
SFAAEQAGAAALLPLGAAAD

SEQ ID NO: 2060 - protein, 20 aa, Homo sapiens
QAGAAALLPLGAAADHHSLY

SEQ ID NO: 2061 - protein, 20 aa, Homo sapiens
ALLPLGAAADHHSLYKARTP

SEQ ID NO: 2062 - protein, 20 aa, Homo sapiens
GAAADHHSLYKARTPSASAS

SEQ ID NO: 2063 - protein, 20 aa, Homo sapiens
HHSLYKARTPSASASASSAA

SEQ ID NO: 2064 - protein, 20 aa, Homo sapiens
KARTPSASASASSAASASAA

SEQ ID NO: 2065 - protein, 20 aa, Homo sapiens
SASASASSAASASAALAAPG

SEQ ID NO: 2066 - protein, 20 aa, Homo sapiens
ASSAASASAALAAPGKHLAE

SEQ ID NO: 2067 - protein, 20 aa, Homo sapiens
SASAALAAPGKHLAEKKVKR

SEQ ID NO: 2068 - protein, 20 aa, Homo sapiens
LAAPGKHLAEKKVKRVYLFG

SEQ ID NO: 2069 - protein, 20 aa, Homo sapiens
KHLAEKKVKRVYLFGGLGTS

SEQ ID NO: 2070 - protein, 20 aa, Homo sapiens
KKVKRVYLFGGLGTSSSPVG

SEQ ID NO: 2071 - protein, 20 aa, Homo sapiens
VYLFGGLGTSSSPVGGVGAG

SEQ ID NO: 2072 - protein, 20 aa, Homo sapiens
GLGTSSSPVGGVGAGADPSD

SEQ ID NO: 2073 - protein, 20 aa, Homo sapiens
SSPVGGVGAGADPSDPLGLY

SEQ ID NO: 2074 - protein, 20 aa, Homo sapiens
GVGAGADPSDPLGLYEEEGA

SEQ ID NO: 2075 - protein, 20 aa, Homo sapiens
ADPSDPLGLYEEEGAGCSPD

SEQ ID NO: 2076 - protein, 20 aa, Homo sapiens
PLGLYEEEGAGCSPDAPSLS

SEQ ID NO: 2077 - protein, 20 aa, Homo spaiens
EEEGAGCSPDAPSLSGRSSA

SEQ ID NO: 2078 - protein, 20 aa, Homo sapiens
GCSPDAPSLSGRSSAASSPA

SEQ ID NO: 2079 - protein, 20 aa, Homo sapiens
APSLSGRSSAASSPAAGRSP

SEQ ID NO: 2080 - protein, 20 aa, Homo sapiens
GRSSAASSPAAGRSPADHRG

SEQ ID NO: 2081 - protein, 20 aa, Homo sapiens
ASSPAAGRSPADHRGYASLR

SEQ ID NO: 2082 - protein, 20 aa, Homo sapiens
AGRSPADHRGYASLRAASPA

SEQ ID NO: 2083 - protein, 20 aa, Homo sapiens
ADHRGYASLRAASPAPSSAP

SEQ ID NO: 2084 - protein, 20 aa, Homo sapiens
YASLRAASPAPSSAPSHASS

SEQ ID NO: 2085 - protein, 20 aa, Homo sapiens
AASPAPSSAPSHASSSASSH

SEQ ID NO: 2086 - protein, 20 aa, Homo sapiens
PSSAPSHASSSASSHSSSSS

SEQ ID NO: 2087 - protein, 20 aa, Homo sapiens
SHASSSASSHSSSSSSSGSS

SEQ ID NO: 2088 - protein, 20 aa, Homo sapiens
SASSHSSSSSSSGSSSSDDE

SEQ ID NO: 2089 - protein, 20 aa, Homo sapiens
SSSSSSSGSSSSDDEFEDDL

SEQ ID NO: 2090 - protein, 20 aa, Homo sapiens
SSGSSSSDDEFEDDLLDLNP

SEQ ID NO: 2091 - protein, 20 aa, Homo sapiens
SSDDEFEDDLLDLNPSSNFE

SEQ ID NO: 2092 - protein, 20 aa, Homo sapiens
FEDDLLDLNPSSNFESMSLG

SEQ ID NO: 2093 - protein, 20 aa, Homo sapiens
LDLNPSSNFESMSLGSFSSS

SEQ ID NO: 2094 - protein, 20 aa, Homo sapiens
SSNFESMSLGSFSSSSALDR

SEQ ID NO: 2095 - protein, 20 aa, Homo sapiens
SMSLGSFSSSSALDRDLDFN

SEQ ID NO: 2096 - protein, 20 aa, Homo sapiens
SFSSSSALDRDLDFNFEPGS

SEQ ID NO: 2097 - protein, 20 aa, Homo sapiens
SALDRDLDFNFEPGSGSHFE

SEQ ID NO: 2098 - protein, 20 aa, Homo sapiens
DLDFNFEPGSGSHFEFPDYC

SEQ ID NO: 2099 - protein, 20 aa, Homo sapiens
FEPGSGSHFEFPDYCTPEVS

SEQ ID NO: 2100 - protein, 20 aa, Homo sapiens
GSHFEFPDYCTPEVSEMISG

SEQ ID NO: 2101 - protein, 20 aa, Homo sapiens
FPDYCTPEVSEMISGDWLES

SEQ ID NO: 2102 - protein, 20 aa, Homo sapiens
TPEVSEMISGDWLESSISNL

SEQ ID NO: 2103 - protein, 20 aa, Homo sapiens
SEMISGDWLESSISNLVFTY

SEQ ID NO: 2104 - protein, 15 aa, Homo sapiens
FMVWSQIERRKIMEQ

SEQ ID NO: 2105 - DNA, 45 bp, Homo sapiens
ttcatggtgtggtcgcagatcgagcggcgcaagatcatggagcag

SEQ ID NO: 2106 - protein, 10 aa, Homo sapiens
IPFIREAERL

SEQ ID NO: 2107 - DNA, 30 bp, Homo sapiens
atccctttcattcgagaggcggagcggctg

SEQ ID NO: 2108 - protein, 14 aa, Homo sapiens
QIERRKIMEQSPDM

SEQ ID NO: 2109 - DNA, 42 bp, Homo sapiens
cagatcgagcggcgcaagatcatggagcagtcgcccgacatg

SEQ ID NO: 2110 - protein, 15 aa, Homo sapiens
SGHIKRPMNAFMVWS

SEQ ID NO: 2111 - DNA, 45 bp, Homo sapiens
agtgggcacatcaagcgacccatgaacgccttcatggtgtggtcg

SEQ ID NO: 2112 - protein, 10 aa, Homo sapiens
KRLGKRWKLL

SEQ ID NO: 2113 - DNA, 30 bp, Homo sapiens
aagcggctgggcaaacgctggaagctgctc

SEQ ID NO: 2114 - protein, 16 aa, Homo sapiens
SEMISGDWLESSISNL

SEQ ID NO: 2115 - DNA, 48 bp, Homo sapiens
agcgagatgatctcgggagactggctcgagtccagcatctccaacctg

SEQ ID NO: 2116 - protein, 15 aa, Homo sapiens
SMSLGSFSSSSALDR

SEQ ID NO: 2117 - DNA, 45 bp, Homo sapiens
agcatgtccctgggcagcttcagttcgtcgtcggcgctcgaccgg

SEQ ID NO: 2118 - protein, 5 aa, Homo sapiens
AAAAA

SEQ ID NO: 2119 - protein, 19 aa, Homo sapiens
MESSAKMESGGAGQQPQPQ

SEQ ID NO: 2120 - protein, 20 aa, Homo sapiens
GAGQQPQPQPQQPFLPPAAC

SEQ ID NO: 2121 - protein, 20 aa, Homo sapiens
QQPFLPPAACFFATAAAAAA

SEQ ID NO: 2122 - protein, 20 aa, Homo sapiens
FFATAAAAAAAAAAAAAQSA

SEQ ID NO: 2123 - protein, 20 aa, Homo sapiens
AAAAAAAQSAQQQQQQQQQQ

SEQ ID NO: 2124 - protein, 20 aa, Homo sapiens
QQQQQQQQQQQQQQAPQLRP

SEQ ID NO: 2125 - protein, 20 aa, Homo sapiens
QQAPQLRPAADGQPSGGGHK

SEQ ID NO: 2126 - protein, 19 aa, Homo sapiens
DGQPSGGGHKSAPKQVKRQ

SEQ ID NO: 2127 - protein, 20 aa, Homo sapiens
KSAPKQVKRQRSSSPELMRC

SEQ ID NO: 2128 - protein, 20 aa, Homo sapiens
RSSSPELMRCKRRLNFSGFG

SEQ ID NO: 2129 - protein, 20 aa, Homo sapiens
KRRLNFSGFGYSLPQQQPAA

SEQ ID NO: 2130 - protein, 20 aa, Homo sapiens
YSLPQQQPAAVARRNERERN

SEQ ID NO: 2131 - protein, 20 aa, Homo sapiens
VARRNERERNRVKLVNGFAT

SEQ ID NO: 2132 - protein, 20 aa, Homo sapiens
RVKLVNGFATLREHVPNGAA

SEQ ID NO: 2133 - protein, 20 aa, Homo sapiens
LREHVPNGAANKKMSKVETL

SEQ ID NO: 2134 - protein, 20 aa, Homo sapiens
NKKMSKVETLRSAVEYIRAL

SEQ ID NO: 2135 - protein, 20 aa, Homo sapiens
RSAVEYIRALQQLLDEHDAV

SEQ ID NO: 2136 - protein, 20 aa, Homo sapiens
QQLLDEHDAVSAAFQAGVLS

SEQ ID NO: 2137 - protein, 20 aa, Homo sapiens
SAAFQAGVLSPTISPNYSND

SEQ ID NO: 2138 - protein, 20 aa, Homo sapiens
PTISPNYSNDLNSMAGSPVS

SEQ ID NO: 2139 - protein, 20 aa, Homo sapiens
LNSMAGSPVSSYSSDEGSYD

SEQ ID NO: 2140 - protein, 20 aa, Homo sapiens
SYSSDEGSYDPLSPEEQELL

SEQ ID NO: 2141 - protein, 16 aa, Homo sapiens
PLSPEEQELLDFTNWF

SEQ ID NO: 2142 - protein, 8 aa, Homo sapiens
LLDFTNWF

SEQ ID NO: 2143 - protein, 20 aa, Homo sapiens
MRCHAHGPSCLVTAITREEG

SEQ ID NO: 2144 - protein, 20 aa, Homo sapiens
LVTAITREEGGPRSGGAQAK

SEQ ID NO: 2145 - protein, 20 aa, Homo sapiens
GPRSGGAQAKLGCCWGYPSP

SEQ ID NO: 2146 - protein, 20 aa, Homo sapiens
LGCCWGYPSPRSTWNPDRRF

SEQ ID NO: 2147 - protein, 20 aa, Homo sapiens
RSTWNPDRRFWTPQTGPGEG

SEQ ID NO: 2148 - protein, 20 aa, Homo sapiens
WTPQTGPGEGRHERHTQTQN

SEQ ID NO: 2149 - protein, 20 aa, Homo sapiens
RHERHTQTQNHTASPRSPVM

SEQ ID NO: 2150 - protein, 20 aa, Homo sapiens
HTASPRSPVMESPKKKNQQL

SEQ ID NO: 2151 - protein, 20 aa, Homo sapiens
ESPKKKNQQLKVGILHLGSR

SEQ ID NO: 2152 - protein, 20 aa, Homo sapiens
KVGILHLGSRQKKIRIQLRS

SEQ ID NO: 2153 - protein, 20 aa, Homo sapiens
QKKIRIQLRSQCATWKVICK

SEQ ID NO: 2154 - protein, 20 aa, Homo sapiens
QCATWKVICKSCISQTPGIN

SEQ ID NO: 2155 - protein, 20 aa, Homo sapiens
SCISQTPGINLDLGSGVKVK

SEQ ID NO: 2156 - protein, 20 aa, Homo sapiens
LDLGSGVKVKIIPKEEHCKM

SEQ ID NO: 2157 - protein, 20 aa, Homo sapiens
IIPKEEHCKMPEAGEEQPQV

The invention claimed is:

1. A composition comprising a first component selected from the group consisting of physiologically acceptable carriers and immunostimulants, and a second component selected from isolated polypeptides comprising an immunogenic portion of the amino acid sequence of SEQ ID NO:809, wherein said immunogenic portion comprises at least ten contiguous amino acid residues of the amino acid sequence of SEO ID NO:809.

2. The composition of claim 1, wherein the second component is an isolated polypeptide comprising the amino acid sequence of SEQ ID NO:809.

3. The composition of claim 1, wherein the immunogenic portion consists of contiguous amino acid residues of SEQ ID NO:809 selected from the group consisting of: 16-35, 21-40, 26-45, 31-50, 71-90, 86-105, 91-110, 96-115, 101-120, 106-125, 111-130, 116-135, and 131-150.

4. The composition of claim 1, wherein the second component is an isolated polypeptide consisting of the amino acid sequence of SEQ ID NO:1964.

* * * * *